(12) United States Patent
Abe et al.

(10) Patent No.: US 11,021,725 B2
(45) Date of Patent: Jun. 1, 2021

(54) MUTANT FILAMENTOUS FUNGUS AND SUBSTANCE PRODUCTION METHOD IN WHICH SAID MUTANT FILAMENTOUS FUNGUS IS USED

(71) Applicants: TOHOKU UNIVERSITY, Miyagi (JP); KANAZAWA INSTITUTE OF TECHNOLOGY, Ishikawa (JP)

(72) Inventors: Keietsu Abe, Miyagi (JP); Akira Yoshimi, Miyagi (JP); Ken Miyazawa, Miyagi (JP); Fuka Tabata, Miyagi (JP); Katsuya Gomi, Miyagi (JP); Motoaki Sano, Ishikawa (JP)

(73) Assignees: TOHOKU UNIVERSITY, Miyagi (JP); KANAZAWA INSTITUTE OF TECHNOLOGY, Ishikawa (JP)

( * ) Notice: Subject to any disclaimer, the term of this patent is extended or adjusted under 35 U.S.C. 154(b) by 0 days.

(21) Appl. No.: 16/610,172

(22) PCT Filed: May 1, 2018

(86) PCT No.: PCT/JP2018/017474
§ 371 (c)(1),
(2) Date: Jan. 2, 2020

(87) PCT Pub. No.: WO2018/203566
PCT Pub. Date: Nov. 8, 2018

(65) Prior Publication Data
US 2020/0115726 A1    Apr. 16, 2020

(30) Foreign Application Priority Data
May 2, 2017 (JP) .............................. JP2017-091734

(51) Int. Cl.
| | | |
|---|---|---|
| *C12P 19/04* | (2006.01) | |
| *C12N 15/87* | (2006.01) | |
| *C12R 1/645* | (2006.01) | |
| *C12R 1/69* | (2006.01) | |

(52) U.S. Cl.
CPC .............. *C12P 19/04* (2013.01); *C12N 15/87* (2013.01); *C12R 1/645* (2013.01); *C12R 1/69* (2013.01)

(58) Field of Classification Search
CPC . C12R 1/645; C12R 1/69; C12P 19/04; C12P 21/02; C12N 15/87; C12N 15/09
See application file for complete search history.

(56) References Cited

U.S. PATENT DOCUMENTS

| 6,251,655 | B1 | 6/2001 | Minambres Rodriguez et al. |
| 6,558,920 | B1 | 5/2003 | Hata et al. |
| 2015/0307852 | A1 | 10/2015 | Abe et al. |

FOREIGN PATENT DOCUMENTS

| JP | 11-506025 | 6/1999 |
| JP | 2001-46078 | 2/2001 |
| JP | 2002-218970 | 8/2002 |
| JP | 2005-52116 | 3/2005 |
| JP | 2007-508022 | 4/2007 |
| JP | 2009-118783 | 6/2009 |
| JP | 2010-172343 | 8/2010 |
| JP | 2010-227031 | 10/2010 |
| JP | 2010-227032 | 10/2010 |
| WO | 2004/097012 | 11/2004 |
| WO | 2005/040369 | 5/2005 |
| WO | 2014/073674 | 5/2014 |
| WO | 2015/184526 | 12/2015 |

OTHER PUBLICATIONS

Sheppard et al., The Journal of Biological Chemistry, 2016, vol. 291, No. 24, p. 12529-12537, published online Apr. 21, 2016.*
Beauvais et al., PLoS Pathogens, 2013, vol. 9, Issue 11, e1003716, pp. 1-15.*
International Search Report dated Aug. 7, 2018 in International (PCT) Application No. PCT/JP2018/017474.
Yoshimi et al., "Functional Analysis of the α-1,3-Glucan Synthase Genes agsA and agsB in *Aspergillus nidulans*: AgsB Is the Major α-1,3-Glucan Synthase in This Fungus", PLOS ONE, Jan. 2013, vol. 8, No. 1, e54893, pp. 1-16.
Report of Medical Mycology Research Center, Chiba University, 2016, vol. 20, pp. 48-49, with English translation.
Bamford et al., "Sph3 Is a Glycoside Hydrolase Required for the Biosynthesis of Galactosaminogalactan in *Aspergillus fumigatus*", The Journal of Biological Chemistry, Nov. 2015, vol. 290, No. 46, pp. 27438-27450.
Fontaine et al., "Galactosaminogalactan, a New Immunosuppressive Polysaccharide of *Aspergillus fumigatus*", PLoS Pathogens, Nov. 2011, vol. 7, No. 11, 7e1002372.
Rappleye et al., "RNA interference in *Histoplasma capsulatum* demonstrates a role for α-(1,3)-glucan in virulence", Molecular Microbiology, 2004, vol. 53, No. 1, pp. 153-165.
Beauvais et al., "Two α(1-3) Glucan Synthases with Different Functions in *Aspergillus fumigatus*", Applied and Environmental Microbiology, Mar. 2005, vol. 71, No. 3, pp. 1531-1538.

(Continued)

*Primary Examiner* — Kade Ariani
(74) *Attorney, Agent, or Firm* — Wenderoth, Lind & Ponack, L.L.P.

(57) ABSTRACT

Provided is a mutant filamentous fungus, which lacks expression of α-1,3-glucan, and is deficient in at least part of a GAG biosynthetic cluster. Also provided is a method of producing a substance, including the steps of: culturing the filamentous fungus to allow the filamentous fungus to produce a substance; and collecting the resulting substance.

7 Claims, 106 Drawing Sheets
Specification includes a Sequence Listing.

(56) References Cited

OTHER PUBLICATIONS

Maubon et al., "AGS3, an α(1-3)glucan synthase gene family member of *Aspergillus fumigatus*, modulates mycelium growth in the lung of experimentally infected mice", Fungal Genetics and Biology, 2006, vol. 43, pp. 366-375.

Henry et al., "α1,3 Glucans Are Dispensable in *Aspergillus fumigatus*", Eukaryotic Cell, Jan. 2012, vol. 11, No. 1, pp. 26-29.

Mizutani et al., "A defect of LigD (human Lig4 homolog) for nonhomologous end joining significantly improves efficiency of gene-targeting in *Aspergillus oryzae*", Fungal and Biology, 2008, vol. 45, pp. 878-889.

Zhang et al., "Self-excising Cre/mutant lox marker recycling system for multiple gene integrations and consecutive gene deletions in *Aspergillus oryzae*", Journal of Bioscience and Bioengineering, 2017, vol. 123, No. 4, pp. 403-411.

Gomi et al., "Integrative Transformation of *Aspergillus oryzae* with a Plasmid Containing the *Aspergillus nidulans* argB Gene", Agricultural and Biological Chemistry, 1987, vol. 51, No. 9, pp. 2549-2555.

Suyotha et al., "Domain Structure and Function of α-1,3-Glucanase from *Bacillus circulans* KA-304, an Enzyme Essential for Degrading Basidiomycete Cell Walls", Bioscience, Biotechnology, and Biochemistry, 2013, vol. 77, No. 3, pp. 639-647.

Miyazawa et al., "Increased enzyme production under liquid culture conditions in the industrial fungus Aspergillus oryzae by disruption of the genes encoding cell wall [alpha]-1,3-glucan synthase", Bioscience, Biotechnology, and Biochemistry, 2016, vol. 80, No. 9, pp. 1853-1863.

Yoshimi et al., "Cell wall structure and biogenesis in Aspergillus species", Bioscience, Biotechnology, and Biochemistry, 2016, vol. 80, No. 9, pp. 1700-1711.

Extended European Search Report dated Feb. 2, 2021 in corresponding European Patent Application No. 18794769.2.

* cited by examiner

Figs. 1
(A)
GAG BIOSYNTHETIC CLUSTER OF A. fumigatus
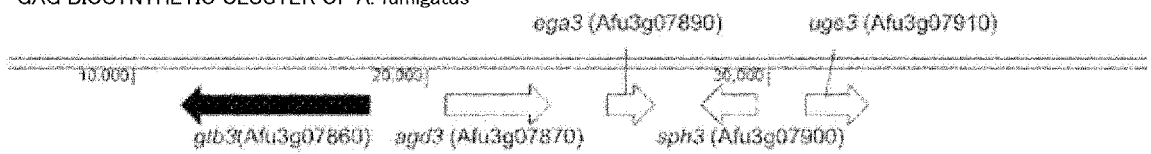
GAG BIOSYNTHETIC CLUSTER OF A. oryzae
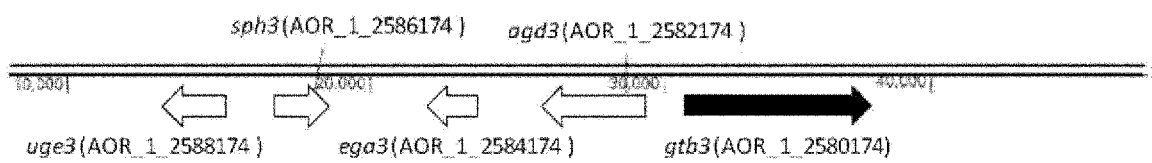
(B)
| | | | | |
|---|---|---|---|---|
| Sph3$_{Af}$ | 100% | 156 G L F F D E T | 194 V H N P G A I | 212 T V V F E A |
| Sph3$_{Ac}$ | 87% | 162 G I F F D E T | 200 V H N P G A I | 218 T V V F E A |
| Sph3$_{Ao}$ | 77% | 157 G I F F D E T | 195 V H N P G A V | 213 T V V F E A |
| Sph$_{Mo}$ | 37% | 125 G I F F D E S | 163 I H N P G T V | 182 T T I F E T |
| Sph$_{Rp}$ | 22% | 90 G F F I D E M | 125 T G N P G T N | 145 L V V F E D |
| Lav6-1 | 21% | 189 G I F L D E A | 222 I L N P G T Q | 240 I V I F E A |

Figs. 2
(A)
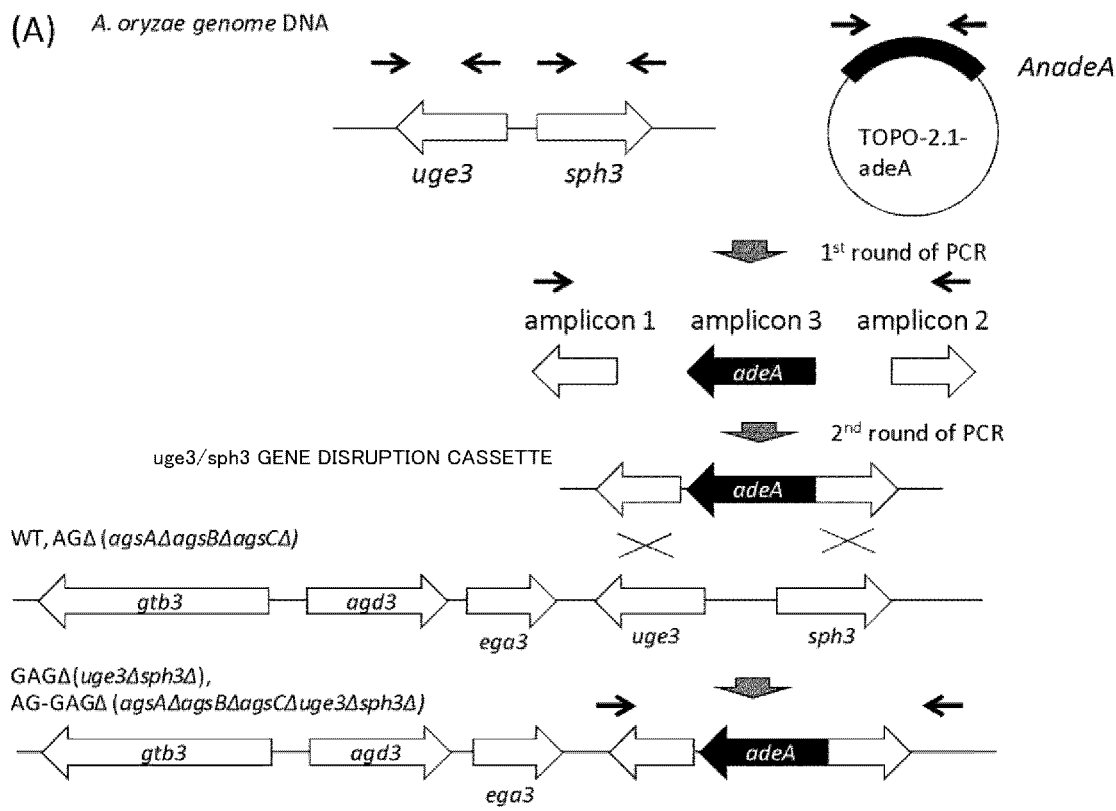
(B)
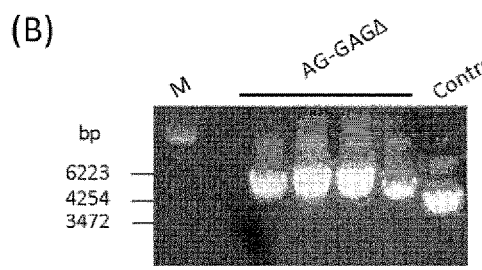

Figs. 3
(A)
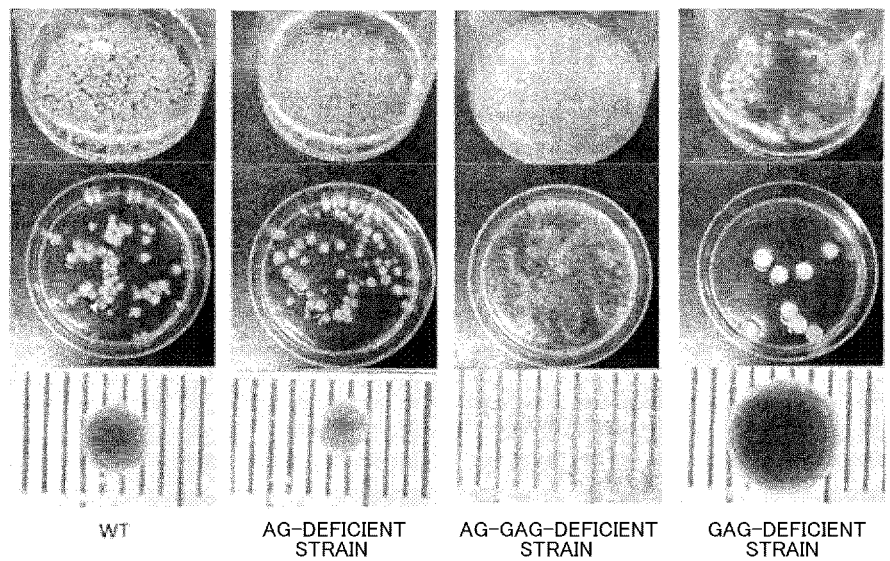
WT    AG-DEFICIENT STRAIN    AG-GAG-DEFICIENT STRAIN    GAG-DEFICIENT STRAIN
(B)
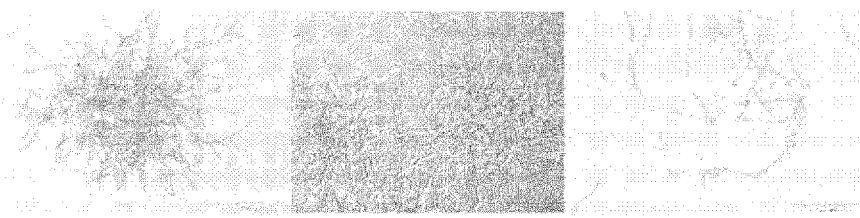
WT    AG-DEFICIENT STRAIN    AG-GAG-DEFICIENT STRAIN
(C)
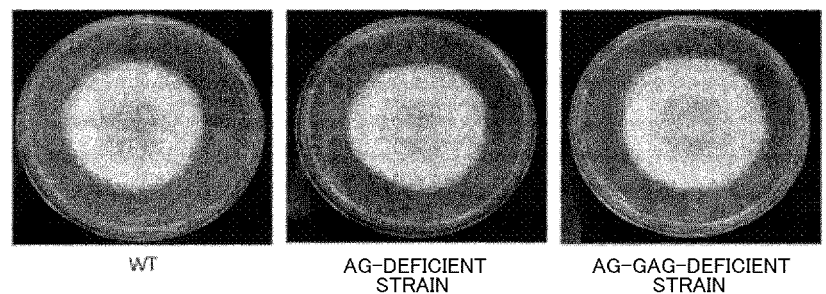
WT    AG-DEFICIENT STRAIN    AG-GAG-DEFICIENT STRAIN Figs. 4
(A)
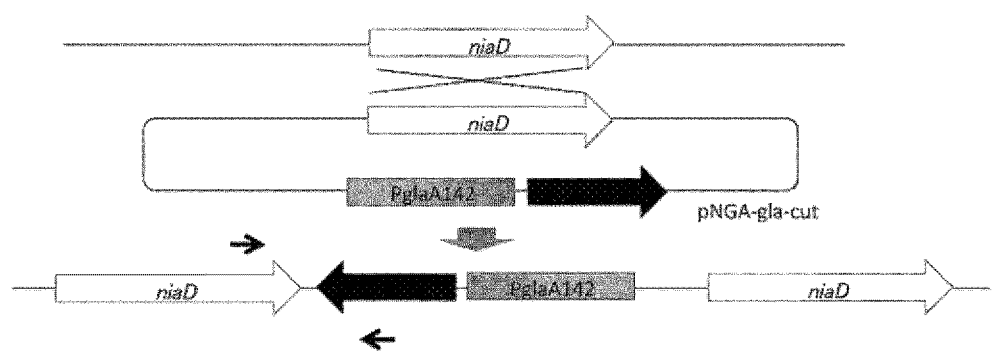
(B)
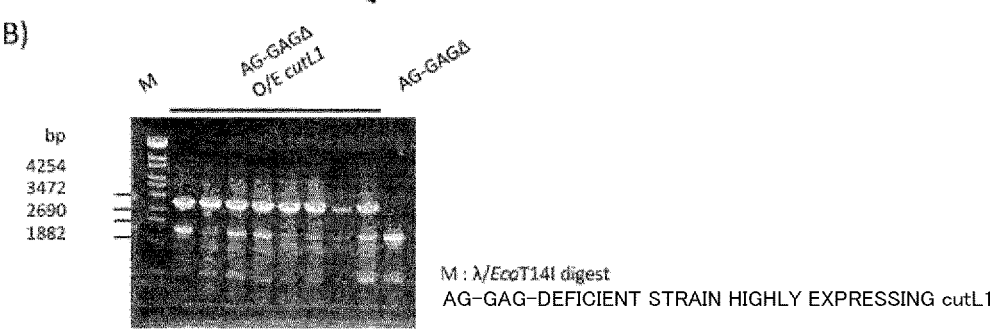
M : λ/EcoT14I digest
AG-GAG-DEFICIENT STRAIN HIGHLY EXPRESSING cutL1
(C)
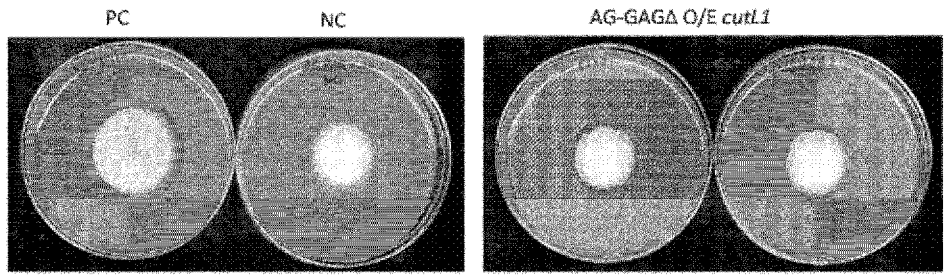

Figs. 5
(A)
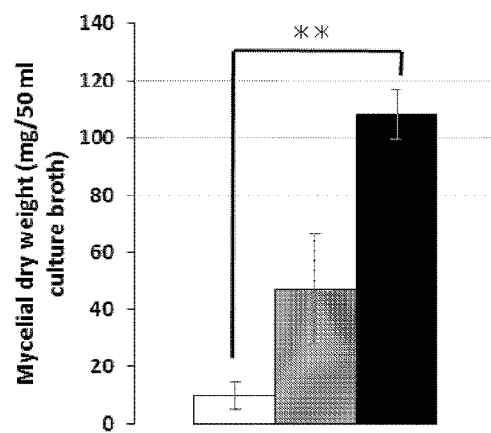
(B)
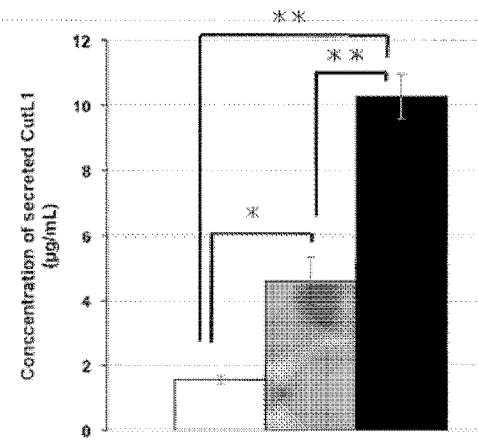

Fig. 6
PUTATIVE AMINO ACID SEQUENCE OF Aspergillus oryzae AgsA  (Genbank accession No. AOR_1_956014)

MKWGFTGPLLALLAATAAGWPYDESLVDYNLNVNKDTTNPAEYTHAEWKGHEYNPSPKSWRFPFYTLFIDRFVNGDPTND
NINGSLFEHDLNSNQMRHGGDAAGLVDTLDYLQGMGIKGIYLAGTILMNQPWGSDGYSILDTTLLDQHYGTIQTWRDAIT
EIHKRGMYVLFDNTIATMGDLIGFEGYLNTTTPFSVKEHKALWKSDRQYVDFRFDNEYNNTCEYPRFWNETGYPVDKDVT
DELVGCYNSDFDQYGDREAFGVYPDWERQLAKFASVQDRLREWHPSVKERLIRHSCMIIKALDIDGFRYDKATQATVDAL
GDMSHAYRECARSVGKDNFFLPGEITGGNNFGSIYLGRGRQPNQYPDSSLASMNLTNTSDHQYFLRDDGLQALDSAAFHY
SVYRTLTRFLGMDGNLAAGYDTPLDWTDSWNIMVLSNDMINANTGKFDPRHMYGTTNQDVFRWPAIELGVERQLLGHFIT
TLHLPGIPILLWGEEQAFYILDSTADNYIYGRQAMSPSTAWKTHGCYSLGSSQYYNWPVSAGREGCHDEAVAYDHRDPSH
PVHNIIKHMFQMRQDFPVLNDGYSVVKLSKQTREIQYPGSNGTATEVGVWSVLRDLVSNIQDFGDSGNNEPVWLVYQNDN
KTVEYSFDCGSNDSALISPFTTGTTVVNLFYPHDEHELKDGPKSLHLNGTNATNGCLDTLKLKPFEFRAYVPKANFVKPR
PMITQFEPGHDVPQLSKVGPDESEDIDVSIYFSTKMDCDQVTKSISFESSTEAGKTPSISNNSVSCKDAKGDDPKWTGQI
PNAWVWTAKLTGVYNGIHRLTVKNATSSDGHSSTQATDHFLIRVGQRDNPLVFTSANYSTSLLNQYDNGTLYIQHRAAGA
NKYRYSTNFGSSFSDWKDYHGGNDTIEELPWSGTDKQKWQGKHVRVEYWNKLTGSSDYAQEGDSGYDHPRRFPHLFFNGP
FNQYGYDAGLDNVVRQDSDGLWKFRFMAEFPAQGQFNVWGMNPDGQPDQSYVFGDVDDDGVLDRMPPSSLSSTIINITDI
PPSPYLAWNLGVDDGTLRVHLLPTGSRTIQMVVYFLLWFVPLVTAIACVYAFVKSFYQVKFNQVGVSEKKSILPLAFRRK
LSRDGSGGSINPFMRLANKSGFLQSTPAFGAVASRRRTTLIATMEYDIEDWAIKIKIGGLGVMAQLMGKHLGQQDLIWVV
PCVGGVDYPVDQPAEPMFVTVLGNSYEVKVQYHVLNNIKYVLLDAPVFRQQTKSEPYPARMDDLDSAIYYSAWNQCIAQA
IRRFPIDLYHINDYHGSIAPLYLLPQTIPVCLSLHNAEFQGLWPMRTQKERDEVCSVFNLDLDTAKRYVQFGEVFNMLHA
GASYLRVHQQGFGAVGVSRKYGKRSYARYPIFWGLKKVGNLPNPDPSDTGEWNKELPKDSEIRVDPNYEASRGELKRQAQ
EWAGLDQNPDADLLVFVGRWSMQKGVDLIADVMPAVLEARPNVQLICVGPVIDLYGKFAALKLDHMMRLYPGRVFSKPEF
TALPAYIFSGAEFALIPSRDEPFGLVAVEFGRKGALGIGARVGGLGQMPGWWYNIESTTTSHLLHQFKLAIGSALNSKPQ
VRAKMRARSAKQRFPVAQWVEDLEILQTTAMRIHSKGQAKSNGGPLSPSGYNTPSEVITPSGMMTPTIASTGTTTPTGMQ
TPPIAHSREGSYTNLSVNRDSAYGPQQRNTIVYSRDPSPGGNDEPRLSLGRQLSLGFRAGPGHINLRGRRLKRRSQMTNE
ESGTATEESSDDDYFRGEEEVTITREQADEGRHQRNAPRSLASPPNSYFEEGITSGRPPWAQPGNRLSSASVLSVDSVVG
EKKDYKLQKVDPFFTDGTGEYYRMFDQRLEKLNGSNSESQLCIEEYLMKSEKKWFDKFRDARLGRNQSPASSIFQTKGEN
NTPMSSISHEDLGSNESGSDPRAEKDEFLLGRDYVPPSGLRKWMQIRIFGWPVYSFFLGLGQIIAANSYQITLLAGENGQ
TAEKLYGIATVYLVTSIIWWFFFRFFKSVFVLSIPWFLYGASFVIIGLAHFESNGSARGWIQNVGSGVYAAASSSGSLFF
ALNFGDESGVQVKDWVFRACLIQGTQQAYVIGLWYWGTTISSAVANGVTNVNGGIVNSWKMTAICMPIAAFLWAIGLIIF
FGLPNYYRQSPGKVPSFYKSVFRRKIVLWNFVVVILQNFFLSAPYGRNWAFLWSSNHAEAWQVGILVVVFFGVIWVAVLT
LFGYLSKRHSWILPVFACGLGAPRWAQIWWGVSGMGLFLPWAGSSVSGALASRSLWLWLGILDALQGLGFGMILLQTLTR
VHIAFTLLASQVLGSIATIVARACAPNNIGPGPISPDVTAGGSSVANAWFWIALFFQLLICAGFLLFFRKEQLTKP

Fig. 7
BASE SEQUENCE OF NUCLEIC ACID MOLECULE OF Aspergillus oryzae agsA (Genbank accession No. AOR_1_956014)

```
ATGAAGTGGGGATTCACTGGCCCGTTGCTTGCGTTGCTCGCAGCAACAGCAGCAGGCTGGCCCTATGATGAGTCCCTAGT
CGATTATAACTTGAATGTGAACAAGGATACTACCAATCCGGCTGAATATACTCACGCAGAATGGAAGGGCCATGAGTATA
ATCCCTCTCCAAAAAGCTGGCGATTCCCCTTCTATACCCTGTTCATTGACCGGTTTGTCAATGGCGATCCTACTAACGAT
AACATCAACGGGTCACTCTTTGAACATGATCTTAATTCAAACCAAATGCGTCACGGTGGTGATGCAGCTGGCTTGGTCGA
TACACTAGACTACCTACAAGGTATGGGCATAAAGGTTGGTAGCAATGATCTCCGTGTTGTTTCTTGCTATTGGTGTTTAC
CGCATATGGCTGACTGACCTCTACAGGGGATCTATTTGGCTGGTACTATCTTGATGAATCAACCATGGGGCTCAGACGGT
TACTCGATTTTGGATACTACCCTGCTTGATCAGCATTATGGTACAATTCAAACCTGGAGAGACGCGATCACCGAGATTCA
TAAGCGGGGCATGTATGTCCTCTTTGACAATACTATCGCAACGTAAGATGCTGCCCCTCACCTAAGTCGTTATATCCCAG
AGCTGACATGAAACCAGCATGGGCGATTTGATTGGATTTGAAGGTTATTTGAATACTACCACGCCTTTCTCAGTCAAGGA
GCACAAAGCATTGTGGAAATCTGACCGTCAGTATGTCGACTTCCGTTTTGACAATGAGTACAACAACACTTGCGAATACC
CTCGATTCTGGAACGAGACTGGCTATCCGGTCGATAAGGATGTCACAGATGAGCTGGTTGGATGCTATAACAGTGATTTC
GACCAGTACGGTGACAGAGAAGCTTTCGGTGTCTACCCAGACTGGGAGCGCCAGTTGGCCAAATTCGCTTCAGTTCAGGA
TCGTCTACGTGAATGGCACCCTAGCGTTAAAGAGAGACTTATTCGGCACTCGTGTATGATTATAAAGGCACTTGACATTG
ATGGCTTCCGCTACGATAAAGCGACGCAGGCCACAGTGGATGCTCTTGGAGACATGTCCCATGCTTATAGAGAGTGTGCT
CGCAGTGTTGGCAAGGATAACTTCTTCCTTCCTGGAGAAATTACTGGTGGAAATAACTTTGGTTCTATTTACCTCGGACG
TGGAAGACAGCCCAACCAATACCCAGACTCCTCCTTGGCTTCGATGAACCTGACGAACACCTCCGATCATCAGTATTTCT
TACGTGATGACGGTCTACAAGCGCTAGATTCAGCAGCTTTCCATTATTCGGTGTACCGTACCCTCACTCGATTCCTAGGT
ATGGATGGCAATCTGGCTGCGGGCTATGACACACCGTTGGACTGGACGGACTCCTGGAATATTATGGTATTGAGCAACGA
TATGATCAATGCTAACACTGGCAAATTTGACCCCCGGCATATGTATGGTACTACAAACCAGGATGTTTTCCGTTGGCCTG
CCATCGAGCTCGGAGTCGAGAGACAGCTTTTGGGTCACTTCATCACAACCTTGCATCTCCCGGGCATCCCAATTTTGCTG
TGGGGAGAAGAACAAGCCTTCTACATTCTAGACTCTACTGCGGATAACTATATCTATGGCCGCCAAGCAATGTCTCCCTC
CACTGCGTGGAAAACACACGGATGTTATTCCCTTGGTTCGTCCCAATACTACAACTGGCCTGTCAGTGCAGGTAGGGAAG
GATGTCATGATGAAGCTGTCGCTTATGATCATCGAGATCCCTCTCATCCAGTCCACAATATCATCAAACATATGTTCCAG
ATGCGACAGGACTTCCCTGTACTAAATGATGGATACTCAGTTGTCAAGTTGTCAAAACAGACTCGTGAGATTCAGTATCC
TGGTTCGAATGGCACGGCAACGGAAGTCGGCGTCTGGTCAGTCCTGCGTGATCTTGTCTCCAACATTCAAGACTTTGGTG
ACAGCGGCAACAACGAACCTGTCTGGCTGGTCTATCAAAATGACAACAAGACCGTGGAATATAGCTTTGATTGTGGGAGT
AACGATTCGGCCTTGATTTCCCCATTTACTACGGGAACTACTGTTGTTAATCTCTTCTACCCACACGATGAACACGAGCT
TAAAGATGGCCCCAAATCACTTCATCTGAACGGCACCAATGCAACAAACGGTTGTCTGGATACTTTGAAGTTGAAGCCCT
TCGAGTTCAGGGCTTACGTTCCAAAGGCTAACTTTGTTAAGCCTCGTCCCATGATCACCCAGTTCGAGCCTGGTCACGAT
GTGCCGCAGCTGTCTAAAGTCGGACCTGACGAATCAGAAGATATTGACGTGAGCATTTACTTTTCCACCAAGATGGATTG
TGATCAGGTTACGAAATCCATTTCATTCGAATCCAGTACCGAAGCTGGCAAGACTCCCTCTATCAGTAATAACAGTGTCA
GCTGCAAAGATGCCAAGGGTGATGATCCGAAGTGGACTGGTCAAATTCCCAAGCGCTGGGTCTGGACAGCGAAGTTGACT
GGCGTTTACAACGGTATCCATCGCTTGACCGTCAAAAATGCCACTAGCTCGGATGGGCATAGTTCTACCCAGGCAACTGA
TCACTTCTTGATCCGAGTGGGCCAAAGGGATAATCCGTTGGTGTTCACATCTGCGAACTACTCGACCTCCTTGTTAAACC
AGTATGACAATGGCACGCTCTACATCCAACATCGTGCAGGAGGTGCAAACAAATACCGCTATTCAACAAACTTTGGTTCC
TCATTCTCTGACTGGAAAGACTACCACGGAGGGAACGATACTATTGAAGAACTGCCCTGGAGTGGAACGGACAAGCAAAA
GTGGCAAGGGAAGCACGTGCGAGTCGAATACTGGAATAAGTTAACCGGCAGCAGTGACTACGCTCAGGAAGGCGACTCTG
GATATGACCATCCAAGACGCTTTCCCCATCTTTTCTTCAACGGGCCATTCAACCAATATGGATATGATGCGGGCTTGGAC
AACGTTGTGAGGCAAGACAGTGATGGTCTTTGGAAGTTCAGATTCATGGCTGAGTTTCCAGCACAAGGACAGTTCAATGT
TTGGGGAATGAATCCAGATGGTCAACCAGACCAGAGCTACGTGTTCGGTGATGTTGATGATGACGGAGTTTTGGATCGCA
TGCCTCCTTCTTCGCTTAGTTCCACGATAATAAACATCACGGATATCCCTCCATCTCCATACTTGGCGTGGAATCTTGGT
GTTGACGATGGAACTCTGCGTGTTCATCTTCTGCGCAACGGGTTCAAGGACCATCCAAATGGTTGTGTACTTCCTCCTCTG
GTTTGTTCCCCTTGTCACAGCCATCGCTTGTGTCTATGCCTTCGTGAAATCCTTCTACCAAGTCAAGTTCAACCAAGTGG
GGGTCAGCGAAAAGAAATCAATTCTTCCATTGGCATTCCGAAGGAAACTGAGCCGTGATGGAAGCGGGGGATCAATCAAT
CCTTTCATGCGCCTTGCCAATAAGTCGGGATTCTTGCAAAGCACACCTGCTTTTGGAGCAGTCGCTTCACGAAGACGGAC
GACCTTGATTGCCACCCATGGAATATGATATTGAGGACTGGGCCATCAAGATTAAAATCGGTGGTCTAGGTGTTATGGCTC
AGTTGATGGGCAAACACCTTGGGCAGCAGGATCTAATTTGGGTTGTTCCATGCGTGGGTGGAGTTGACTACCCGGTAGAT
CAGCCAGCTGAGCCTATGTTTGTGACAGTGCTCGGAAATTCCTACGAAGTCAAGGTGCAGTATCACGTCCTGAATAATAT
```

Fig. 8

```
TAAATATGTCCTTTTAGATGCTCCTGTTTTTCGTCAACAGACCAAATCTGAGCCTTATCCCGCCCGAATGGACGATTTGG
ACAGCGCAATCTACTATTCCGCTTGGAACCAGTGCATTGCACAAGCAATCAGACGTTTCCCAATTGATCTTTATCATATT
AACGACTACCATGGATCCATTGCCCCTCTTTATCTTCTACCTCAAACCATCCCTGTATGTCTGTCGCTCCACAATGCCGA
GTTCCAAGGACTGTGGCCTATGCGCACCCAGAAGGAGAGGGATGAAGTCTGTTCTGTTTTCAACCTTGATCTTGACACTG
CAAAGCGCTACGTCCAATTTGGCGAAGTTTTTAACATGCTTCATGCTGGAGCAAGCTACCTACGCGTGCATCAACAAGGG
TTTGGTGCAGTGGGCGTTTCTCGAAAGTACGGTAAACGTTCTTATGCCCGGTACCCAATCTTTTGGGGTCTGAAGAAGGT
TGGAAATCTACCGAACCCGGACCCTTCAGACACTGGCGAATGGAACAAGGAGTTACCAAAGGACAGCGAGATTCGGGTTG
ACCCGAACTACGAGGCTAGCAGAGGAGAGCTTAAGCGGCAGGCGCAGGAATGGGCAGGCTTGGATCAAAACCCTGATGCC
GACCTGTTGGTGTTTGTTGGAAGATGGTCTATGCAGAAGGGCGTGGACCTTATTGCTGATGTGATGCCTGCCGTTCTGGA
AGCACGTCCCAATGTTCAACTCATCTGTGTTGGTCCAGTCATTGATCTTTATGGTAAATTTGCTGCTCTTAAGCTGGATC
ATATGATGAGGTTATATCCTGGGCGTGTCTTCTCAAAGCCTGAGTTTACTGCACTCCCAGCATATATCTTCTCTGGCGCC
GAATTCGCCCTGATTCCATCTCGTGATGAACCTTTTGGTCTTGTTGCTGTCGAATTTGGTCGAAAGGGCGCTCTTGGTAT
TGGTGCTCGTGTTGGTGGTCTCGGCCAGATGCCTGGTTGGTGGTATAATATTGAGTCTACAACAACTTCCCATCTCTTGC
ATCAATTCAAGCTTGCGATTGGAAGCGCGCTTAACTCGAAGCCCCAAGTTCGTGCAAAGATGCGTGCACGCTCCGCAAAG
CAACGCTTTCCTGTTGCTCAGTGGGTGGAAGATTTGGAAATTCTGCAGACCACTGCTATGCGGGATTCACAGCAAGGGACA
GGCAAAATCGAACGGTGGACCTCTCTCGCCTTCTGGTTACAATACACCAAGTGAAGTAATAACACCAAGTGGAATGATGA
CACCTACGATTGCATCGACTGGTACCACGACCCCAACGGGAATGCAGACGCCTCCAATCGCACACTCACGGGAAGGCAGT
TACACGAATCTCAGCGTCAATCGCGACAGTGCATACGGGCCCCAACAGCGCAACACAATTGTGTACAGCCGTGACCCAAG
CCCTGGAGGTAATGACGAACCTAGGTTAAGCCTTGGTCGGCAACTGTCACTTGGATTCAGGGCTGGACCAGGACATATTA
ATCTCCGTGGTCGTCGGCTTAAAAGAAGAAGCCAGATGACCAACGAGGAGAGTGGTACAGCGACCGAAGAAAGCAGTGAT
GACGATTATTTCCGCGGAGAGGAAGAAGTTACGATTACGAGGGAGCAAGCAGATGAAGGACGTCATCAACGCAATGCTCC
GAGGTCGCTTGCATCTCCTCCCAACTCTTACTTTGAAGAAGGCATAACATCCGGAAGGCCACCTTGGGCTCAACCTGGGA
ATCGACTCAGTAGTGCATCCGTTCTTTCTGTTGATTCTGTCGTCGGCGAAAAGAAAGACTATAAGCTGCAGAAAGTTGAT
CCATTCTTCACAGACGGTACTGGCGAATACTATCGAATGTTTGATCAGAGACTCGAAAAGCTCAACGGATCTAACTCTGA
ATCCCAGCTTTGTATAGAGGAGTATCTGATGAAGAGCGAAAAGAAGTGGTTTGACAAGTTCAGAGACGCAAGATTGGGGC
GCAACCAATCTCCCGCTTCTTCGATTTTCCAAACCAAGGGCGAAAACAACACACCTATGAGCTCAATCTCCCACGAGGAT
CTGGGTTCAAACGAAAGTGGCAGCGATCCACGCGCAGAAAAGGATGAGTTCCTTCTGGGACGAGACTATGTTCCCCCCTC
GGGCTTAAGGAAATGGATGCAAATTCGAATCTTTGGCTGGCCTGTGTATTCGTTTTTCCTAGGTCTCGGTCAGATCATTG
CGGCCAACTCATACCAAATTACCTTGCTTGCCGGTGAAAACGGCCAGACAGCTGAGAAGCTCTATGGTATTGCGACAGTA
TACCTTGTCACTTCAATCATCTGGTGGTTTTTCTTCCGCTTCTTCAAATCGGTGTTTGTCCTTTCCATACCTTGGTTCTT
ATACGGCGCATCGTTTGTCATCATTGGATTAGCACACTTTGAGTCAAATGGCTCCGCTCGTGGATGGATCCAGAATGTGG
GAAGCGGTGTTTACGCTGCTGCTTCTTCAAGCGGATCACTGTTCTTCGCTCTCAATTTTGGCGATGAAAGCGGTGTTCAG
GTTAAAGACTGGGTTTTCCGGGCATGCCTCATCCAAGGAACCCAGCAAGCATATGTTATTGGACTGTGGTACTGGGGAAC
GACAATCTCTAGCGCTGTCGCCAATGGAGTTACCAACGTCAACGGCGGCATTGTCAACTCCTGGAAAATGACGTATGTTT
CACCTTTATCACTATGATTACAATTGCTAACGGCCTCTTCTAGCGCAATCTGCATGCCAATCGCTGCATTCCTCTGGGCC
ATTGGTCTGATAATCTTCTTCGGCCTGCCCAATTACTACCGCCAGTCACCTGGAAAAGTTCCATCATTCTACAAGTCTGT
CTTCCGGCGCAAGATCGTCCTGTGGAACTTCGTGGTAGTCATTTTGCAAAATTTCTTCCTCAGCGCACCTTATGGACGAA
ACTGGGCCTGTAAGTACATCAGACCTATACTCTCCAAGAAGCCACTAACTTATCGTGCCTCATACAGTCCTTTGGAGCTC
AAACCATGCCGAAGCCTGGCAAGTCGGCATCCTCGTCGTCGTCTTCTTCGGTGTCATCTGGGTAGCAGTGTTAACCCTAT
TTGGATATCTCTCGAAGCGCCATAGCTGGATTCTACCTGTATTTGCATGCGGTTTGGGAGCTCCACGTTGGGCCCAGATA
TGGTGGGGTGTCTCCGGAATGGGTCTCTTCCTTCCCTGGGCTGGCAGTTCTGTTAGCGGAGCACTCGCATCACGAAGTCT
ATGGCTCTGGCTCGGTATCCTTGATGCCTTACAGGGTCTCGGCTTCGGCATGATTCTTCTCCAGACCCTCACACGAGTAC
ATATAGCCTTCACCCTGCTTGCATCTCAAGTGCTGGGATCCATCGCGACAATCGTCGCCAGAGCATGTGCTCCAAATAAC
ATCGGTCCTGGACCAATCTCGCCGGATGTGACTGCCGGTGGCAGTTCCGTTGCAAACGCTTGGTTCTGGATCGCCTTATT
CTTCCAGCTCTTGATCTGGTAAGTCATCGATCCCCCTACAATCCATTTCACAGGCAGCAAAATGCTAACAAAGCCCCAGC
GCCGGATTCCTTCTGTTCTTCCGGAAAGAACAACTCACCAAGCCCTAA
```

Fig. 9
PUTATIVE AMINO ACID SEQUENCE OF Aspergillus oryzae AgsB  (Genbank accession No. AOR_1_2634154)

```
MKWAFSSAVLALFATTVKAWPYEESLSAYNLNENKSATNPAQYWGEWPDHKGKYFPSPDNWRFPVYTLFMDRFVNGDPTN
DNINGTLFEHDISSTQMRHGGDVAGLVDTLDYLQGMGIKAIYLAGTILMNQPWGSDGYSALDTTLLDQHFGDIATWRNAI
DEIHKRGMYVIFDNTIATMGDLIGFEGHLNDTTPFSVKEHKALWKSNRRYVDFDIGNDYNQTCDYPRFWYEDGYPVQQSM
TEGLVGCYDSDFDQYGDIEAFGVFPDWQRQLAKFASVQDRLREWHPSVRERLIRHSCMIIYQLDIDGFRYDKATQSTVDA
LGDMSMAYRECARAVGKENFFISGEITGGNTFGSIYLGRGRQPNQYPETAEKAMKMTNESESQYFLREAGHEAIDGAAFH
YSTYRALTRFLGMDGNLAAGYDVPVDWVDAWNLMLQSNDFINPNTGKFDPRHMFGATNQDVFRWPTVEKGVERQLLGLYI
TTLLLPGIPLLLWGEEQAFYILDATASNYIYGRQAMSPATAWRDHGCFSLDSSQYYQWPIQAGREGCHDPTAAYDHRDPA
HPVRNIIKHMYQLREDFPVLNDGYSVQKLSNLTEEVFYPGSNGTATETGLWSILRDVNADVQDLGSDAKNQPVWLVYHNT
NRTIDFKFNCKDNETALISPFATGTKVRNLFYPYDEHTLIDGPVKLGLNGSTELNGCLANMTLDAYEFRAYVPSARFTKP
RPMITQFTPGHDVPVRSTVAPNLDESVKIELYFSEEMDCDSVTKAISISSSTESKKVPTLDEKTVDCKGIPASNTSWTGQ
LPSVFMWAANLTGVYNGIHRVTVKNASSTNGNATTNAVDHFLFRIGQIDNPMVFTSANYSTSLLHEESNGTLFIQHHAAG
ADKWRYSTNWGTTFSEWKDYTGGNDTITELEWSGTKKQRWKGHHVRVEYWSKWTGSSDYVQEGDAGVHSNVPRRFPHIFF
NGPYNQYGYDGGLDNVVRQDSKDGLWKYHFTAEWPAQAQLNIWGMNPDGKPDQSWVLGDADNDSVLDRMPPSSLSATLIN
ITEHPPKPYLAWNIYINDATMKFQLFPVGHQNTQIAMFVLFWIIPVITGAACVYIFMKSFYKVKFNQIGVSEKATLIPLA
LRRKFKRNRGGDEERMNPLMRLANKSGFLQTNTAIGGAASGKRRMVLIATMEYDIEDWQIKIKIGGLGVMAQLMGKTLGH
QDLIWVVPCVGGVEYPVDKPAEPMNVTILGNSYEVQVQYHVLNNITYVLLDAPVFRQQSKSEPYPARMDDLNSAIYYSAW
NQCIAEACKRFPIDLYHINDYHGSLAPLYLLPDTVPACLSLHNAEFQGLWPMRTQKEKEEVCSVFNLDIDIVRRYVQFGE
VFNLLHSGASYLRVHQQGFGAVGVSKKYGKRSYARYPIFWGLRKVGNLPNPDPSDVGEWSKEKAIGNADEVHVDPDYEAG
RADLKRQAQEWAGLDVNPDADLMVFVGRWSMQKGVDLIADVMPAVLEARPNVQVICVGPVIDLYGKFAALKLDHMMKVYP
GRVFSRPEFTALPPYIFSGAEFALIPSRDEPFGLVAVEFGRKGALGIGARVGGLGQMPGWWYNVESTATSHLLYQFKLAI
DAALNSKQETRAMMRARSAKQRFPVAQWVEDLEILQTTAIQVHNKELVKHNGRPFTPTGTTTPSGLMTQPASPLGTPGMQ
TPLAHSRESSYSNLNRLSEYVTQPKTSYSRDPSPSGTEKPKSGLQRQLSLGVRSGPGHQSRRGRARQRDSIPEHEDTQEA
HGGAITDVEEESSDDDIVNHYADDEYTLTPAQVEEGRRLQAAQQQAGGRRYSQDSLHPRNVQPPSSPGTPPAASQSLLPP
PRLLDPGSRLSSASVLSLDSVVGGKKDFKLQKVDPFFTDSTGEYYKIFDKKLDELNGSNSESQLCIEEYLIKSEKEWFDK
FRDARLGRTKSPTPSVYRDKHGASPIGSFYDDNGSRMSGSDGPHSNDSEDDEFLLGKDYVPPTGLKKWMQIRIGDWPIYS
LFLALGQIIAANSYQITLLTGEVGQTAEKLYGIATTYLITSILWWLVFRYFKSVVCLSAPWFLYGIAFIFIGSAHFESNS
FTRGWIQNVGSGFYAAASSSGSFFFALNFGDEGGAPVETWIFRACLIQGIQSAYVIALWYWGSTLSQAQSEGLLTPTNNI
SNSWKISAICYPIAAALFGIGLLLTFGLPNYYRQTPGKVASFYKSVFRRKIVLWNFVAVILQNFFLSAPYGRNWQFLWTS
HHAHHWQIVILCVVFYGFVWAGFLFVVSRYFKSHSWFLPVFACGLGAPRWAQIWWGVSGIGYYLPWVTGGYTGGALVSRS
VWLWLGVLDSIQGLGFGIILLQTLTRMHMLFCLVCSQVLGSIATICARAFAPNNVGPGPVSPDPTFGGSAVANAWFWVAL
FCQLLVCAGYILFFRKEQLSKP
```

Fig. 10
BASE SEQUENCE OF NUCLEIC ACID MOLECULE OF Aspergillus oryzae agsB (Genbank accession No. AOR_1_2634154)

```
ATGAAGTGGGCTTTCTCCAGTGCGGTGCTGGCGCTTTTCGCAACAACAGTAAAAGCCTGGCCTTACGAAGAATCTCTCTC
CGCATACAACCTTAACGAAAACAAATCCGCGGACCAACCCGGCTCAATATTGGGGAGAATGGCCGGACCACAAGGGGAAAT
ACTTCCCTTCTCCCGACAATTGGCGATTTCCCGTCTATACTCTGTTCATGGACCGCTTTGTCAACGGAGACCCTACGAAC
GACAACATCAATGGAACCCTCTTCGAGCACGATATCTCCTCGACACAAATGCGCCATGGTGGAGATGTGGCTGGTCTAGT
GGATACTTTGGATTATCTTCAGGGAATGGGTATCAAGGTTCGTCATTCGTTCAGGTTAATTACGTGGCATGCCATACTGA
GAATTCTTAGGCCATCTATCTCGCAGGAACCATCTTGATGAACCAGCCATGGGGCTCTGATGGTTATTCCGCTCTCGATA
CGACACTGCTCGATCAACATTTCGGTGACATTGCGACATGGCGTAATGCTATCGACGAGATTCATAAGCGCGGGATGTAT
GTCATCTTCGATAACACGATTGCTACGTAAGTCTCGCCGCATCCACGGTACATATGAGATGATTGTTAACGCTTGTATTC
AGGATGGGTGATCTCATCGGCTTCGAGGGCCATCTGAATGATACCACCCCGTTTTCGGTTAAGGAGCATAAAGCACTTTG
GAAGAGCAATCGTCGCTATGTGGATTTCGATATAGGAAACGACTATAACCAGACATGCGACTACCCCCGTTTCTGGTACG
AGGACGGTTATCCAGTTCAACAGTCTATGACTGAAGGCCTTGTTGGTTGTTATGACAGCGACTTTGATCAATATGGTGAT
ATTGAGGCTTTCGGCGTGTTCCCTGATTGGCAACGTCAGCTAGCAAAATTCGCCTCCGTCCAAGATCGTCTGCGAGAATG
GCACCCCTCGGTCCGGGAGCGGTTGATTCGTCATTCCTGTATGATTATTTACCAGTTGGATATCGACGGTTTCCGTTATG
ATAAGGCTACTCAGTCGACCGTGGATGCGCTAGGAGATATGTCGATGGCTTATCGCGAATGCGCCCGTGCCGTTGGCAAG
GAGAATTTCTTCATCTCCGGTGAAATTACTGGTGGTAACACTTTTGGTTCCATCTATTTGGGCCGAGGTAGACAGCCGAA
CCAGTATCCTGAGACGGCGGAGAAGGCCATGAAAATGACCAACGAGTCCGAGTCGCAATACTTCCTGCGTGAAGCTGGAC
ATGAGGCGATCGACGGTGCGGCCTTCCACTATTCGACATATCGTGCCCTGACTCGGTTCTTGGGTATGGACGGTAACTTG
GCCGCCGGTTACGATGTACCTGTGGATTGGGTCGATGCGTGGAATCTGATGTTGCAGTCGAACGACTTCATCAACCCTAA
CACAGGCAAGTTTGATCCCCGCCATATGTTCGGCGCGGACCAACCAGGATGTTTTCCGCTGGCCGACAGTCGAAAAGGGTG
TGGAAAGACAGTTGCTTGGGCTGTATATCACTACCTTACTTCTTCCGGGTATTCCCCTCCTCCTTTGGGGCGAGGAACAG
GCATTCTATATCTTGGATGCGACGGCATCTAACTATATCTATGGCCGTCAAGCAATGTCCCCCGCGACTGCGTGGAGAGA
CCACGGTTGCTTTTCCTTGGATTCCTCACAGTATTACCAGTGGCCTATTCAGGCCGGTCGTGAGGGTTGCCATGACCCAA
CTGCTGCGTACGATCATCGTGATCCGGCCCACCCGGTGCGCAACATTATCAAGCACATGTACCAGCTGCGCGAAGACTTC
CCTGTTCTGAATGATGGCTACTCCGTCCAGAAACTCTCGAACCTGACCGAGGAGGTCTTCTATCCGGGTTCCAACGGTAC
CGCTACAGAAACGGGTTTGTGGTCTATCCTACGTGATGTCAATGCCGATGTGCAGGACCTAGGCTCCGACGCGAAGAATC
AACCGGTGTGGCTCGTCTACCACAACACCAACCGTACAATTGACTTCAAGTTCAACTGCAAGGACAACGAGACTGCACTA
ATCTCGCCCTTCGCCACCGGCACCAAAGTTCGAAATCTGTTCTATCCCTATGACGAGCACACCTTGATTGATGGCCCCGT
CAAGCTTGGACTGAACGGATCTACCGAGCTCAATGGCTGCCTGGCCAACATGACATTGGACGCCTATGAGTTCCGCGCCT
ACGTCCCCAGTGCACGTTTCACTAAGCCTCGTCCAATGATCACCCAATTCACTCCCGGCCATGACGTCCCTGTTCGCTCC
ACGGTGGCTCCCAATCTGGATGAAAGCGTGAAGATTGAGCTCTATTTCTCCGAAGAGATGGACTGCGATTCTGTGACCAA
AGCGATTTCCATCAGCTCATCTACGGAATCTAAAAAGGTCCCGACGCTGGATGAGAAGACTGTAGACTGCAAGGGAATTC
CAGCAAGCAACACCTCCTGGACTGGGCAGCTTCCTAGCGTCTTCATGTGGGCTGCCAACCTGACGGGAGTGTATAACGGC
ATCCACCGAGTCACGGTTAAGAACGCTAGCAGTACTAATGGAAACGCGACAACAAACGCGGTCGACCACTTCCTCTTCCG
TATCGGACAAATCGATAACCCCATGGTCTTTACATCGGCCAACTATTCGACTAGTTTGCTCCACGAGGAATCGAATGGCA
CCCTATTCATCCAGCACCACGCAGCTGGTGCTGATAAGTGGCGTTATTCCACCAATTGGGGCACCACTTTCTCCGAGTGG
AAGGATTACACAGGTGGTAATGACACTATCACGGAGTTAGAATGGTCTGGAACCAAGAAACAGAGATGGAAGGGACACCA
TGTGCGGGTCGAGTACTGGAGCAAATGGACCGGTAGCAGCGATTACGTTCAGGAGGGCGATGCTGGAGTGCATTCGAATG
TGCCACGCCGCTTCCCCCATATCTTCTTCAACGGCCCTTACAATCAGTACGGATATGACGGTGGTCTTGATAACGTGGTG
AGGCAGGACTCCAAAGACGGACTCTGGAAATATCACTTCACGGCGGGATGGCCGGCTCAAGCCCAGCTGAACATCTGGGG
CATGAATCCGGATGGAAAGCCTGATCAAAGCTGGGTGCTGGGTGATGCCGATAATGATTCCGTTCTGGATCGAATGCCAC
CCTCCTCTCTCTGCAACCTTGATTAACATCACCGAGCATCCGCCTAAGCCATATCTGGCTTGGAATATCTACATCAAC
GATGCGACCATGAAGTTCCAGCTCTTCCCTGTTGGGCACCAGAACACGCAGATCGCCATGTTCGTGCTCTTCTGGATCAT
CCCTGTCATCACCGGTGCAGCATGCGTCTACATTTTCATGAAGTCTTTCTATAAGGTCAAGTTCAACCAAATCGGTGTGA
GTGAAAAAGCCACATTGATCCCGTTGGCCTTGCGGAGAAAGTTCAAGAGGAATCGTGGTGGTGATGAGGAAAGGATGAAC
CCCTTGATGCGTCTGGCCAACAAGTCCGGTTTCCTGCAGACCAACACCGCTATTGGCGGCGCTGCTTCTGGCAAGCGACG
CATGGTTCTTATCGCGACAATGGAGTATGATATCGAGGATTGGCAGATTAAGATCAAGATTGGTGGTCTTGGTGTCATGG
CCCAGCTTATGGGGAAAACTCTCGGACATCAGGACCTGATCTGGGTTGTTCCCTGTGTCGGGGGAGTCGAATACCCAGTG
GATAAACCCGCTGAGCCCATGAATGTCACGATTCTTGGCAACTCTTATGAGGTTCAGGTCCAGTACCATGTCTTGAACAA
```

Fig. 11

```
TATCACCTACGTTCTACTAGACGCCCCTGTGTTCCGCCAGCAATCGAAGTCCGAACCCTATCCAGCCCGTATGGATGACC
TCAACAGTGCTATCTACTACTCTGCCTGGAATCAGTGTATCGCTGAGGCCTGCAAGCGGTTCCCGATTGACCTGTACCAT
ATCAACGATTATCACGGTTCTCTAGCTCCGCTCTACCTTCTTCCCGATACAGTACCGGCTTGTCTTTCCCTTCACAACGC
TGAATTCCAGGGTCTCTGGCCAATGCGTACACAGAAAGAAAAGGAGGAGGTGTGCTCCGTCTTTAACCTAGATATTGATA
TTGTCAGACGTTATGTGCAGTTCGGTGAGGTTTTCAACTTGCTGCACTCAGGTGCTAGTTATCTTCGTGTTCACCAGCAG
GGTTTCGGTGCCGTCGGTGTGTCCAAGAAGTACGGAAAGCGGTCCTACGCCCGTTATCCCATCTTCTGGGGTTTGAGGAA
GGTCGGCAACTTGCCTAACCCTGATCCTTCGGATGTGGGAGAATGGAGTAAGGAAAAGGCTATTGGTAACGCTGACGAGG
TCCATGTGGATCCCGACTATGAGGCCGGCAGGGCAGACCTCAAACGCCAGGCTCAGGAATGGGCTGGTCTTGATGTCAAC
CCTGACGCTGATCTAATGGTGTTCGTTGGTCGTTGGTCCATGCAGAAAGGTGTCGATTTAATCGCCGATGTGATGCCAGC
TGTTCTTGAAGCTCGCCCTAACGTGCAGGTAATCTGTGTTGGACCTGTTATCGATCTTTATGGTAAATTCGCTGCCCTGA
AGTTGGACCACATGATGAAGGTTTACCCTGGACGTGTGTTCTCGAGACCTGAATTCACCGCTCTTCCGCCTTATATCTTC
TCTGGTGCTGAATTCGCGCTTATTCCTTCTCGTGACGAGCCCTTTGGTCTAGTCGCAGTCGAGTTCGGCCGTAAGGGAGC
CTTGGGTATCGGTGCCCGTGTCGGTGGTCTCGGTCAGATGCCTGGATGGTGGTATAACGTCGAATCTACTGGGACATCTC
ATCTTCTGTACCAGTTCAAGCTTGCCATCGACGCCGCACTTAACTCGAAACAAGAGACCAGAGCCATGATGCGTGCCCGT
TCTGCTAAACAGCGATTCCCCGTCGCCCAATGGGTCGAGGACTTGGAAATCCTGCAAACCACCGCAATCCAAGTACACAA
CAAGGAATTGGTCAAGCACAACGGTCGTCCGTTCACTCCGACTGGAACGACTACTCCTAGTGGCCTTATGACTCAACCTG
CGAGCCCTCTCGGGACCCCAGGAATGCAAACTCCTCTTGCTCATTCTAGGGAAAGCAGCTACTCGAACCTCAACCGTCTA
AGTGAATACGTTACCCAGCCAAAGACCAGCTACAGCAGAGATCCCAGCCCTAGCGGCACGGAGAAGCCGAAATCAGGACT
TCAGCGACAGCTTTCCCTTGGTGTTCGCTCTGGACCTGGTCATCAGAGCCGTCGTGGTCGCGCTCGCCAGCGTGACAGCA
TCCCAGAACACGAAGACACCCAGGAAGCTCACGGTGGCGCCATTACTGATGTTGAGGAAGAAAGCAGTGACGACGACATT
GTCAACCATTACGCGGATGACGAGTATACTCTTACACCTGCCCAAGTCGAAGAAGGCCGTAGGTTACAGGCCGCCCAGCA
ACAGGCTGGTGTGCGCATGCCGTTGAGTCCAGGTGGTAGACGCTACAGCCAAGACTCGTTGCATCCGAGAAATGTCCAGC
CTCCTTCGAGTCCCGGAACACCCCCAGCCGCTTCCCAGAGTCTCCTTCCTCCCCCTAGGCTCCTCGATCCCGGCAGTCGT
CTCAGTAGCGCATCCGTTCTCTCACTTGACTCCGTTGTCGGTGGCAAGAAGGACTTCAAGCTGCAAAAGGTTGATCCGTT
CTTCACTGATAGCACCGGCGAGTATTACAAGATCTTTGATAAGAAGCTTGATGAACTCAATGGATCGAACTCGGAGTCGC
AACTGTGTATCGAAGAATACTTGATCAAGAGTGAAAAGGAATGGTTCGACAAGTTCCGTGACGCTAGACTTGGTCGCACT
AAATCGCCAACTCCCTCAGTCTATCGTGATAAGCACGGCGCTTCCCCTATCGGCTCGTTCTACGATGATAACGGCTCCCG
TATGAGTGGTAGCGATGGCCCTCACTCCAATGACAGTGAAGACGACGAGTTCCTCCTCGGGAAAGGACTATGTCCCTCCCA
CCGGTCTCAAGAAGTGGATGCAGATTCGCATCGGTGACTGGCCTATCTACTCCTTGTTCCTCGCTTTAGGCCAAATCATT
GCTGCCAACTCGTACCAGATCACATTGCTCACGGGCGAAGTCGGTCAAACTGCCGAGAAACTGTACGGAATTGCAACCAC
GTATTTGATCACGTCTATTCTCTGGTGGCTTGTGTTCCGCTACTTCAAATCCGTCGTCTGTCTGTCTGCGCCATGGTTCT
TGTACGGTATCGCCTTCATCTTCATTGGATCCGCCCATTTTGAGAGCAACTCTTTCACTCGGGGATGGATTCAAAATGTC
GGTAGTGGGTTCTACGCCGCGGCCTCGTCTAGTGGTTCTTTCTTCTTCGCGCTAAACTTCGGTGATGAAGGTGGTGCACC
TGTGGAAACATGGATCTTCCGTGCATGTCTCATTCAGGGTATCCAGTCCGCCTATGTTATTGCTCTCTGGTACTGGGGTT
CAACCCTGTCACAGGCACAAAGTGAGGGTCTCTTGACTCCTACAAACAATATCTCCAATTCTTGGAAGATTAGGTAGGTT
ATATTGATCTCTTTGGTTAATTTCACTAGCTAACTAATACTTTCACAGTGCCATCTGTTACCCCATTGCCGCGGCCCTTT
TCGGAATTGGTTTGCTCTTGACATTCGGCCTGCCCAACTATTACCGTCAAACCCCTGGCAAGGTCGCTTCCTTCTACAAA
TCCGTGTTCCGTCGTAAGATCGTCCTCTGGAACTTTGTCGCGGTCATCCTTCAGAACTTCTTCCTCAGCGCCCCCTACGG
CCGCAACTGGCAGTGTAAGTTGACCCCTGTATAACGGTTTCCATCATATCAGACCAACTAACTGTGTCTCTTTGCAGTC
CTCTGGACATCCCACCACGCACATCACTGGCAAATCGTCATCCTCTGTGTTGTTTTCTACGGCTTCGTATGGGCAGGCTT
CCTATTCGTCGTCAGTCGCTACTTCAAATCACACAGCTGGTTCCTCCCCGTGTTCGCCTGTGGCCTCGGAGCTCCCCGCT
GGGCACAAATCTGGTGGGGTGTGTCTGGCATTGGCTACTACCTCCCTTGGGTGACAGGAGGATATACCGGCGGCGCGCTC
GTCTCCCGAAGTGTCTGGCTCTGGCTCGGCGTGCTGGACTCGATCCAGGGTCTCGGCTTCGGTATCATCCTCTTGCAAAC
CCTGACTCGCATGCACATGCTTTTCTGTCTTGTTTGTTCTCAAGTCCTTGGTTCTATCGCTACGATCTGCGCGGAGAGCCT
TCGCCCCTAATAATGTGGGCCCAGGGCCGGTTTCGCCTGATCCTACCTTTGGTGGGAGTGCGGTTGCGAATGCCTGGTTC
TGGGTTGCTCTGTTTTGTCAGTTGTTGGTCTGGTAAGTTATTCACATCTTATGAACTTTGTTATATACAACGATCGCTAA
CGTGTGATGATTACAGTGCCGGTTACATCCTCTTCTTCCGGAAAGAACAGCTGTCAAAGCCTTAAGGGCCATGCTTAACT
GTGTGGTGTTTGTTATGATTACTACCGTGAATGTATACATAGTCCAGCTCTCTGGACGTTACTGTCTATCTTAATATAAT
CCTTTGTATATAGATGACCATAATCTGAACATATTCAGATC
```

Fig. 12
PUTATIVE AMINO ACID SEQUENCE OF Aspergillus oryzae AgsC   (Genbank accession No. AOR_1_1350024)

```
MFLTVMQRSAILILSLLSATALSWPYTESLVDYNLNENKTAEAPIDYWGEWPDHEYHPSPDNWRFPIYTIFLDRIANGDP
KNDDINGTAFEHVVGSNQMRHGGDLVGLIDTLDYIRGMGFKGIYFAGTYLMNLPWAYDGYSPVDTTLLDMHHGTLEDWRR
TITEIHKRDMYVIVDNTLATMSNLIGFKGHLNDSADFRADEYEVQWISDRQYADFKFGNEYNETCNFPKFWNETGYPLTS
GGVEELKGCYNSDFDQFGELEAFGNFPDWKRQLTKFASVQDRLREWHKPIRDVITKHSCIQIASLDIDGFRFDKAVQTTL
EPLSEITAVYRECAKKYGKHNFFLPGEITSGNTFGSLYLGRGRQPDQQPESADAGVKLKNSSDGYFLRDDGYQALDSAAF
HYTIYRSMTRFLGMDGNLVAGFDLPTDFIEAWNGMLVSNDFLNAYTGEVDPRHMFGVSNQDNFRWPAIVNGTEKYLLGLY
IVTLELPGIPLILWGEEQAMYVFESTASNYLFGRQPMTYQTAWWTHGCMTLNTSKFYDFPNEKGLHGCEDITVTYDQRNP
AHPLRNIMKRMFEIREQYPVANDGFYLQTLSQLTKDVYLPGSTDTPTVTGLWSVLRSYFPGVQKEASKNSQNLWLKDTAL
LSPFKSGTKLKNLFYPYDELTLEDGPGEIAVHNSTESYGCIRSMKLLPWEYRAYIEAENFVEPGPTVTEFVPGHDARLLS
TDDSGQTVDIQLGYSKEMDCDKIADAISLNSTTVKGVTASLDTSSVSCNKISPRTSSDNFVGEVPTVWTWSAKLKNVHHG
IHQLTVKNVSTTSGVHTDAVDQFLFRVGSQNNPLLSPLSNYSTSLVQKSDNGSFYIQHDAAGADKFRYSTDFGLNWSNWT
TYTGDNTLVDFPEWTGTDAQKWKGTHIRVQYFSRLTGSSDYIQEGDHGWEKGVARRFPNLFWNGPFNQYGYDAGLDNKMR
YDTKDHRWKYDFVYEWPAIGQMSVWGMLKDGRPDVTEVYGDVDNSSVVQKLPPSYLSSNVINITKLPPFPHLGWTITLND
ANLRYEMLPVGSGWAQLVLYILLWVLPILMGFAGIFIFIRTFYRVKLNTDGDVAKEDKLPLLFWRRVREKFSGDDESDKS
ISDKDIPTDIAIAGAPEQRRTVLIATMEYNIEDWKVKVKIGGLGVMAQLMSQHLKHQNLIWVVPCVGDIEYPQDTPSEPF
VVTILDKPYFINVQYHIVDNITYVLLDAPVFRQQTKAEPYPPRMDDLDSAIYYSAWNQCIAETIKRFPSIDLYHINDFHG
CLAPLYLLPTRTIPVCLSLHNAEFQGLWPLRNPQEKKEVCSVFNLPIETATKYSQFGNVFNLLHTGASYVRFYQRGFGAV
GVSKKYGKRSWARYPIFWSLEKIGSLPNPDPSDTGDMTNNADAEVPIQSYEERINDKLQAQKWAGLNEDRDADLLVFVGR
WSKQKGVDLIADVMPAILSARPHVQLICVGPIVDLYGRLAATKLERIMEMFPGRVFSKPEFTVLPPYVFSGADFALIPSR
DEPFGLVAVEFGRKGALGIGSRIGGLGQMPGWWYTVESDATRHLLHQLKTAIKQALDSSQDAREEMRANSVRQHFPVLEW
IQKLEALQRTAIQIHHTKNKNTVTGPMPESQNYWETQSVRMSTLGLPGPTQSVTEGLDTPPGRLLTPGQSRFAELQLEGA
DGNRNSSLGRKLSLGRRSGPGQDRKRPGKSPPRESQILGEDLEGENTDAEEEGTTTPQVNYISPEEAMAAVNNTLGTQDI
GMAHTNNSTHSLAGPQGSTYMSVPGSPNNMSRASSPMPGTPGLPQYPFQFALGSGGNTPFTHSRNVSMLSLPSVVADHNQ
PVFELQKVDPTFTDSTRHFTRRFEEILNNLNKKNSMTDCCIETYLMKSERKFYDMYNDAQLKKQPDDRAVSDSNSDTQDN
RASYATVTGGSDSNDPDEIDLWLSRLGYKRPIAIQRFMRRRLGKWPVYALFLGLGQIIATNSAQMTLLVGQVGETATKLY
IIATIYCISSICWWLLFYRFPSVIVLTLPWFIYCMAFIIIGVSPFALTSLGRAWAQNVAAGVYSAASSSGSLFFALNFGD
QGAVPIKDWMFRASLIQGIQQLYTVALWYWSSKVTEAEVGGVSTAALSSWRLTAVVMPIAAVCFIVGVLLALGLPKYYRQ
SPGRILFFYTSLFRRRIVLWFFFMVIVQNWFLSAAFGRNWSFLWSSQHAKAWEVVILVIFFFVVLWVIILIIFRALSKEH
SWILPVFGLSLGAPRWAQTWWGTSNIGYYLPWAGSLTSGALVSRCVWLWLGVLDEIQQVGLGMILLQTLTRVHVCFVLLA
AQALGSIATICARGFAPNKLGPAGISPNVGTSLDTVGNAWFWIALFFQLLASWGFLLFYRREQLNRP
```

Fig. 13
BASE SEQUENCE OF NUCLEIC ACID MOLECULE OF Aspergillus oryzae agsC(Genbank accession No. AOR_1_1350024)

```
ATGTTCCTCACGGTGATGCAGCGCTCAGCGATCCTTATCCTGTCGTTACTGAGCGCTACCGCCTTAAGCTGGCCATACAC
TGAGTCGCTCGTTGACTATAACCTGAATGAAAATAAAACCGCCGAAGCGCCGATTGATTATTGGGGAGAGTGGCCGGATC
ATGAATATCACCCGTCGCCCGATAACTGGCGCTTTCCGATCTATACCATCTTTTTGGACCGCATCGCTAACGGTGACCCG
AAGAATGATGATATCAATGGCACCGCCTTTGAGCATGTGGTTGGCTCGAATCAAATGCGCCACGGGGGCGATTTGGTTGG
TCTAATTGATACGCTGGATTATATTAGGGGCATGGGTTTCAAGGTGTGTTGAGCCGATTGTGATCCGATCTTGGTGCTTA
CTCTGGTAGGGCATTTACTTCGCTGGAACGTACTTGATGAACCTTCCCTGGGCCTACGATGGCTACTCACCGGTTGATAC
CACTTTGCTCGACATGCACCATGGCACACTCGAGGATTGGAGACGGACCATCACTGAGATCCACAAACGAGATATGTATG
TGATCGTGGATAATACACTGGCAACGTAAGTACATATCCCAGGTGTCTCAGATCAACACTGGTTGACGAGTATATGCAGA
ATGAGCAACCTTATTGGTTTCAAAGGACATCTCAACGATTCAGCCGATTTTCGAGCAGATGAATATGAAGTGCAGTGGAT
CTCAGATAGACAGTACGCGGACTTCAAATTCGGAAATGAGTACAACGAGACCTGCAACTTCCCGAAGTTTTGGAATGAGA
CTGGGTATCCGTTGACATCAGGTGGTGTTGAGGAGCTGAAAGGGTGCTATAATAGCGATTTCGATCAATTTGGAGAGCTG
GAGGCGTTCGGTAACTTTCCAGACTGGAAGCGCCAGCTTACCAAGTTCGCCTCGGTGCAAGATCGTCTGCGTGAATGGCA
CAAGCCTATTCGTGATGTCATCACTAAGCATTCTTGCATTCAGATCGCTAGTCTAGATATCGATGGTTTCCGTTTCGATA
AAGCCGTTCAGACAACCCTCGAGCCCCTAAGTGAAATAACCGCCGTCTACCGTGAGTGTGCGAAGAAATATGGCAAGCAT
AACTTTTTCCTTCCCGGTGAGATCACATCAGGAAATACCTTTGGCAGTCTTTACCTTGGACGCGGTCGTCAGCCAGATCA
GCAGCCTGAATCTGCAGATGCTGGTGTTAAGTTGAAGAATAGTTCGGACGGATATTTTCTCAGAGACGATGGATACCAGG
CGTTGGACTCAGCCGCGTTTCACTACACGATCTACCGTTCGATGACTCGTTTCCTGGGAATGGATGGTAATCTAGTGGCT
GGCTTTGACTTGCCTACTGATTTTATCGAGGCCTGGAATGGGATGCTCGTCAGCAACGACTTCCTCAATGCATACACGGG
TGAAGTAGACCCGAGGCACATGTTTGGTGTCTCAAACCAGGACAACTTTCGCTGGCCAGCAATCGTAAATGGCACCGAGA
AATATCTTCTGGGTCTTTATATCGTCACCTTGGAGCTCCCTGGAATTCCTCTGATCCTATGGGGCGAAGAGCAGGCGATG
TATGTTTTTGAATCTACTGCTTCTAACTACCTGTTCGGCCGGCAGCCAATGACGTATCAGACGGCATGGTGGACACATGG
ATGCATGACTTTGAATACATCCAAATTCTACGATTTCCCTAATGAGAAGGGACTACACGGCTGCGAGGATATCACCGTTA
CGTATGATCAGCGGAATCCGGCACACCCTCTGCGCAATATCATGAAGCGCATGTTCGAAATTCGGGAGCAGTATCCGGTA
GCAAATGATGGGTTTTATCTTCAAACGCTTTCTCAGCTGACAAAGGATGTGTACCTTCCTGGTTCAACGGACACGCCGAC
TGTGACTGGTCTATGGTCGGTTCTGCGGAGCTACTTCCCAGGCGTCCAGAAGGAGGCAAGCAAGAACAGTCAGAACCTTT
GGCTTGTGTATCATAATGCTAACAAAACTGAAACCTACGGTGGTGACTGCAAAAAGAAAGATACCGCCTTGCTGTCGCCT
TTCAAGTCGGGAACTAAGCTGAAGAATCTCTTCTATCCGTACGATGAGCTCACTTTAGAAGATGGTCCGGGCGAAATCGC
AGTCCACAATAGCACTGAGAGCTATGGATGCATCCGCAGTATGAAATTGCTTCCATGGGAATACCGTGCCTACATAGAGG
CCGAGAACTTCGTTGAGCCCGGCCCTACTGTTACTGAGTTCGTTCCTGGCCACGACGCCCGATTGTTGTCTACGGATGAC
AGTGGCCAAACTGTCGACATCCAGCTCGGATATTCAAAAGAGATGGACTGTGACAAGATCGCCGATGCCATCTCTTTGAA
CTCAACGACAGTGAAGGGAGTTACAGCTTCCCTTGACACATCTAGCGTGTCTTGCAACAAAATCTCCCCAAGGACAAGCA
GTGATAACTTTGTTGGGGAGGTTCCAACCGTTTGGACATGGTCTGCCAAGCTGAAAAATGTCCACCACGGAATCCATCAG
CTGACAGTTAAGAACGTTTCCACGACGTCTGGAGTTCATACCGATGCGGTTGACCAGTTCTTATTCCGTGTCGGAAGTCA
AAACAATCCCCTTTTATCCCCACTGTCCAATTATTCCACCAGTCTTGTGCAGAAATCCGACAACGGCAGCTTCTATATCC
AGCATGACGCGCTGGTGCTGATAAATTTCGCTACTCGACTGATTTTGGCCTTAACTGGTCCAACTGGACAACGTATACC
GGTGACAACACCCTAGTCGACTTCCCAGAGTGGACCGGAACAGACGCTCAGAAGTGGAAGGGAACTCATATTCGCGTACA
GTACTTTTCAAGGCTCACCGGCAGTAGTGATTACATTCAGGAAGGTGATCATGGCTGGGAAAAAGGTGTTGCTCGAAGAT
TTCCTAACCTCTTTTGGAACGGTCCGTTCAATCAATATGGTTACGATGCGGGACTGGATAACAAGATGAGATACGATACC
AAGGATCATCGTTGGAAGTACGATTTTGTCTACGAGTGGCCGGCCATTGGACAAATGAGTGTCTGGGGAATGTTAAAGGA
TGGGCGGCCCGACGTTACAGAGGTGTATGGTGATGTCGACAACTCATCTGTAGTTCAGAAACTTCCTCCGTCTTACCTAT
CGTCCAACGTGATCAATATCACAAAGCTGCCTCCATTCCCGCACCTCGGCTGGACCATCACGCTCAATGACGCCAACTTG
AGATATGAGATGCTTCCGGTCGGATCTGGATGGGCCCAGCTCGTGCTATACATTCTTCTCTGGGTGCTTCCAATTCTCAT
GGGATTTGCTGGTATCTTCATCTTCATCAGGACATTCTACCGTGTTAAACTCAATACCGATGGCGATGTGGCCAAAGAAG
ATAAGCTACCGCTCCTGTTTTGGCGGAGGGTCAGAGAAAAGTTCTCCGGCGACGACGAGTCGGATAAGTCGATATCAGAT
AAGGATATACCGACAGACATTGCTATCGCGGGAGCCCCTGAGCAACGTCGTACAGTATTGATCGCCACCATGGAATACAA
CATCGAAGACTGGAAGGTCAAGGTCAAGATCGGCGGTCTAGGCGTCATGGCACAACTCATGTCTCAGCATCTGAAGCATC
AAAACTTGATCTGGGTTGTTCCTTGCGTTGGTGACATTGAATATCCTCAGGACACGCCATCCGAGCCTTTCGTGGTCACT
ATCCTGGACAAGCCATATTTTATCAATGTGCAATATCATATAGTTGATAACATCACCTATGTCCTGCTCGACGCTCCAGT
```

Fig. 14

```
TTTCCGCCAACAGACCAAAGCAGAGCCATATCCTCCTCGCATGGATGATCTTGACAGTGCAATCTACTATTCGGCATGGA
ACCAATGTATCGCAGAGACGATCAAACGATTCCCGTCAATCGATCTCTATCATATCAACGATTTCCATGGTTGTTTAGCA
CCACTGTATTTGCTTCCCACGCGTACCATCCCGGTGTGCCTGTCCTTACATAATGCTGAATTCCAGGGTCTTTGGCCCCT
GAGAAACCCCCAGGAAAAGAAGGAAGTCTGTTCGGTCTTCAACCTTCCCATCGAAACTGCAACCAAGTACAGTCAATTTG
GAAACGTCTTCAACCTTCTTCACACTGGTGCGAGCTATGTGCGATTCTACCAACGCGGTTTCGGCGCAGTAGGTGTGTCC
AAAAAGTATGGAAAGCGCTCATGGGCTAGATACCCGATTTTCTGGAGTCTTGAAAAGATTGGCAGTCTTCCAAACCCAGA
CCCCTCCGACACAGGGGACATGACAAATAACGCAGACGCCGAGGTTCCAATCCAGTCCTACGAAGAACGAATCAATGATA
AGCTACAGGCCCAGAAGTGGGCTGGTTTGAATGAAGATCGTGATGCTGACCTACTTGTGTTCGTCGGGCGATGGTCGAAG
CAGAAGGGAGTGGATTTGATTGCAGATGTCATGCCAGCGATATTATCCGCCAGACCCCACGTGCAATTGATCTGCGTTGG
ACCTATCGTTGATCTCTATGGTAGACTGGCTGCTACAAAGCTAGAGCGCATCATGGAAATGTTCCCTGGTCGCGTCTTCT
CTAAGCCAGAGTTCACCGTTTTGCCTCCATACGTATTTTCTGGTGCCGACTTCGCTCTGATTCCCTCCAGAGACGAACCA
TTTGGGTTAGTCGCTGTAGAGTTCGGCCGTAAGGGTGCACTGGGAATCGGTTCTCGCATTGGAGGTTTAGGCCAGATGCC
AGGTTGGTGGTACACCGTGGAATCCGACGCAACCCGCCATCTTCTGCATCAGTTGAAGACCGCTATCAAACAAGCGTTGG
ACTCATCACAGGACGCTCGTGAGGAGATGCGCGCCAATTCCGTCAGGCAACATTTCCCCGTTCTTGAATGGATTCAGAAA
CTCGAAGCCTTGCAACGAACAGCGATCCAAATCCATCACACCAAGAACAAGAACACCGTGACAGGCCCGATGCCAGAGTC
GCAGAACTATTGGGAGACTCAAAGCGTACGAATGTCTACGCTGGGCCTTCCAGGACCTACCCAGTCGGTGACAGAGGGTT
TGGATACACCGCCAGGAAGGCTTTTGACGCCCGGCCAGTCTCGATTTGCAGAATTGCAATTGGAGGGAGCTGATGGCAAC
AGGAACAGCAGCCTGGGTCGCAAACTCTCGCTCGGTCGGCGATCTGGACCTGGTCAGGACAGAAAACGTCCCGGCAAGAG
CCCGCCGCGCGAGAGCCAGATCCTAGGAGAGGATTTGGAAGGTGAGAACACGGATGCCGAAGAAGAGGGCACCACTACGC
CGCAGGTGAACTATATTTCACCTGAAGAAGCTATGGCTGCAGTTAACAACACTTTGGGAACTCAAGATATCGGAATGGCA
CACACGAACAATAGTACTCACTCGCTCGCTGGTCCTCAAGGATCTACTTACATGTCCGTGCCAGGCTCACCAAACAACAT
GTCACGGGCCTCCTCTCCAATGCCAGGAACCCCGGGGCTGCCCCAATACCCATTCCAGTTCGCATTGGGTTCTGGCGGAA
ATACTCCTTTCACTCACTCCCGCAATGTGTCCATGCTTTCCTTGCCTTCAGTCGTGGCGGACCACAACCAGCCGGTTTTT
GAGCTGCAAAAGGTTGATCGGACCTTTACAGACAGCACACGCCACTTCACGCGACGCTTCGAAGAGATTCTCAACAACCT
GAACAAGAAGAACTCGATGACAGACTGCTGTATCGAGACGTACCTAATGAAGAGCGAGCGTAAATTCTACGACATGTACA
ACGATGCACAATTAAAGAAACAGCCCGATGATCGTGCAGTGTCTGATTCGAATTCAGACACTCAAGATAACCGCGCCTCG
TACGCCACTGTCACTGGAGGTTCGGACTCGAATGATCCGGATGAGATTGATTTATGGCTCTCTCGACTGGGGTATAAACG
ACCGATTGCTATTCAAAGATTCATGAGAAGGCGTCTTGGCAAATGGCCTGTCTACGCTCTATTCCTGGGTCTTGGACAAA
TCATCGCGACCAACTCCGCTCAAATGACCCTGTTGGTCGGTCAGGTAGGAGAAACAGCAACCAAGTTGTACATTATCGCC
ACGATCTACTGCATTTCCTCTATCTGTTGGTGGCTCCTCTTCTATCGATTCCCGTCAGTAATCGTCCTCACTCTCCCCTG
GTTCATTTACTGCATGGCATTTATCATCATTGGCGTCTCTCCATTCGCTCTCACATCTCTCGGTCGAGCCTGGGCCCAGA
ACGTCGCTGCAGGTGTGTATTCCGCCGCATCATCTAGCGGCTCGTTATTCTTCGCCCTCAACTTCGGTGATCAGGGTGCC
GTTCCTATAAAGGATTGGATGTTCCGCGCAAGTCTCATCCAGGGAATCCAGCAGCTCTACACCGTCGCCTTATGGTACTG
GAGCTCGAAGGTGACCGAAGCAGAGGTGGGAGGCGTGTCCACCGCGGCTCTAAGCTCATGGAGACTCACAGCTGTGGTGA
TGCCCATCGCCGCAGTATGTTTCATAGTCGGCGTGCTTCTCGCGCTCGGCCTACCAAAATACTACCGCCAATCCCCGGT
AGGATCCTCTTCTTCTACACATCCCTCTTCCGCCGCCGTATTGTCCTCTGGTTCTTCTTCATGGTAATAGTCCAGAACTG
GTTCCTCTCCGCAGCATTTGGTCGCAATTGGTCATTCCTCTGGTCCTCCCAACACGCTAAGGCATGGGAGGTCGTCATCC
TAGTCATCTTTTTCTTCGTCGTCCTCTGGGTAATCATCCTCATCATATTCCGCGCCCTATCCAAGGAACACAGCTGGATT
CTACCCGTATTTGGTCTGAGTCTCGGCGCACCGGCGCTGGGCCCAAACATGGTGGGGAACGTCCAACATAGGCTACTACCT
GCCATGGGCGGGAAGTCTGACATCCGGTGCCCTCGTGTCGAGATGCGTCTGGCTCTGGCTCGGTGTGCTTGACGAAATCC
AGCAAGTCGGCCTGGGTATGATCCTCCTACAGACACTGACCAGAGTCCACGTGTGCTTCGTTCTGTTGGCCGCACAGGCT
CTCGGATCCATCGCTACGATCTGCGCCCGTGGATTCGCGCCGAATAAGCTCGGGCCCGCGGGAATCTCGCCGAACGTGGG
AACGTCTCTAGATACAGTTGGAAATGCGTGGTTCTGGATCGCGCTCTTCTTCCAGCTTCTGGCTAGGTAAGGCTTCTGTA
TTCCCGGCTTCAATGGATTCAATACTAATGTGGTTCATAGTTGGGGCTTCCTTTTGTTCTATCGTCGTGAGCAGCTTAAT
AGGCCTTAA
```

Fig. 15
PUTATIVE AMINO ACID SEQUENCE OF Aspergillus nidulans AgsA  (Genbank accession No. AN5885)

```
MRWRPLNPLLPLLAATAAGWPYEESLVDYNLNVNKNAATPADYYAPEWRNHTYMPSPENWRFPFYTLFLDRFVNGDPTND
NINGTVYEHDLNSNQMRHGGDAQGLVDTLDYLQGMGIKGIYLAGTILMNQPWGADGYSILDTTLLDQHFGTIQTWRNAIT
EIHKRGMYVLFDNTIATMGDLIGFKGYLNVSAPFSVKEHEAVWKSDRRYVDFDFGNTYNQTCEYPRFWNETGWPVDKDVR
DELQGCYSSDFDQYGDREAFGVYPDWQRQLAKFASVQDRLREWNPSVRERLIRHSCMIIKALDIDGFRYDKATQATVDAL
GDMSSAYREITGGNNFGSIYLGRGRQPNQYPDSAMDSMAMNNESDHQYFLREDGLQALDSAAFHYSIYRSLTRFLGLDGN
LAAGYDTPIDWTDAWNVMVMTNDMINANTGKFDPRHMFGATNQDVFRWPAIKQGIERQLLAMFITTLHLPGIPILLWGEE
QGFYILDATADNYVYGRQAMSPATAWKTHGCFQLTADQYHNWPISKGREGCHDETVTYDHRDPSHPLRNIIKHMYQLRQD
YQVLNDGYSVQKLSNQTRQIFYPGSNGTATETGMWSVLRDSVYKIQELHNEQPVWLVYQNDNKTVEYNFDCSDNDTALIS
PFATKTTVVNLFYPHDEYDLKDGPKKLHLNGSAEFNGCLDSMTLKPFEFKAFVPKERFVKPRPMITKITPGHDQPIISKV
VASEAEDLDLSIYFSAEMDCDSVTKAIKVQSTTEVNKTALIDKDSVKCRRIDPNETRWTAQLPSVWAWSSKLTGVYNGIH
RLTVTNATSEVGGSTQAVDHFLIRIGQIDNPMVFTTANYSTDLLHQHENGTLYIRHKAAGADKYRYSTNWGSSFSNWREY
KGGDEFIEEQPWSGTKKQKWNGKHVRVEYWSKLTGSSSYVQEGDYDTKHQRRFPHLFFNGPYNQYGYDAGLDNEVKQDSD
GYWKYRLRAEFPAQGQFNVWGMNPDGKPDQSFVFGDLDSDGVLDRMPPSSLNTLSINVTDRPPSSYLSWNIWVDDGTMSI
QFQPTGSRTIQMVVYFLLWFVPLVTAIGCVYAFMKSFYQVKFNQIGISQKRSLFGFSVGRKPSLNPLTRLANKSGFLQST
PVFGTGSSRRRSVLIATMEYDIEDWGIRIKIGGLGVMAQLMGKNLGHQDLIWVVPCAGDVDYPEDQPAEPMFVTVLGNIY
EVKVQYHVLNNITYVLLDAPVFRQQSKAEPYPARMDDLDSAIYYSAWNQCIAETIKRFPIDLYHINDYHGSIAPLYLLPQ
TIPVCLSLHNAEFQGLWPMRTQKERDEVCSVFNIDVDVARRYVQFGEVFNMLHAGASYLRVHQQGFGAVGVSRKYGKRSY
ARYPIFWGLKKVGNLPNPDPSDTAEWNKELPKESEIQVDQNYEASRAELKRQAQEWAGLEQNPNADLMVFVGRWSMQKGI
DLIADVMPAVLEAHPNVQLICVGPVIDLYGKFAALKLDRMMQLYPGRVFSKPEFTALPPYIFSGAEFALIPSRDEPFGLV
AVEFGRKGALGIGARVGGLGQMPGWWYNVESTTTAHLLHQFKLAIGCALNSKPQVRARMRARSAKQRFPVAQWVEDLEIL
QSTAMRIHSKGLAKASVQPYNSGSNTPLGMMTPPIASTGTVTPTGIQTPPLAHSRSGSYSNINRLSAYGPQQRNTIIYSR
DPSPGGEDQPRSGIRQLSLGVRAGPGHLMRRGRRRLRRNSHAGTDENASVSMTEESSDDDIIPSFYGEEEYTLTPEQAEE
VRRADMTPQQEQNHGSVRDFFTRRHSSQSSILSRSVLSPASSTTFDGDETFVPPAPPFAEPGNRLSSASVLSVDSVVGEK
KDYKLQKVDPTFTDSTGEFYKVFERKLEKLNGSNSISQLCIEEYLEKSEKKWFDRFRDARLGRKQSPSSSIFRTKFEGSS
PMALVSNDEVGSRASGSEPRMRPDEFCLGNDYVPPSGLKKWMQVRIFDWPIYSFILGLGQIIAANSYQITLLTGEVGQRP
EKLYGIATVYLVSSIVWWFLFRFCKSVVVLSLPWLFYGFAFVLIGVAHYEGDSFARAWIQNVGAGVYAAASASGSLFFAL
NFGDENGAPVKNWVWRACIIQGTQQAYIIGLWYWGTSISQAVTRGVPDVQAHITETWRMTTICMPIAVFLWVLGILVFFG
LPNYYRQTPGKVPSFYQSVCRRKIILWNFVVVILQNFFLSAPYGRNWSFLWSSVHAEPWHIGLLVVAFFGVAWVLILCIF
ARLSKSHSWILPVFACGLGAPRWAQIWWGVSGMGLFLPWAGSYTTGALVSRSLWLWLGILDSLQGLGFGMILLQTLTRMH
ICFTLLASQVLGSIATICARAFAPNNIGPGPISPDITDGAGAVANAWFWIALFFQLLICSFPIDVMS
```

Fig. 16
BASE SEQUENCE OF NUCLEIC ACID MOLECULE OF Aspergillus nidulans agsA   (Genbank accession No. AN5885)
```
ATGAGGTGGAGGCCTTTAAACCCGTTACTTCCGCTGCTTGCAGCAACCGCAGCAGGCTGGCCCTACGAAGAGTCATTAGT
TGATTATAATCTCAACGTGAACAAAAACGCTGCCACCCCAGCAGATTATTACGCACCGGAATGGAGGAACCACACATATA
TGCCGTCGCCAGAGAACTGGAGGTTTCCATTCTACACCCTGTTTCTGGACAGATTCGTCAACGGCGACCCTACTAACGAT
AATATTAACGGAACTGTCTATGAACATGATTTGAACTCCAACCAGATGCGACACGGCGGTGATGCACAAGGCCTGGTAGA
CACACTCGACTACCTTCAAGGAATGGGAATCAAGGTCTGATTTTTGTTTTCGTCTCAGCTTCAGCCTTCGCTAACCAGAT
CTTGTTTAGGGGATCTACCTCGCGGGTACTATTCTCATGAATCAACCCTGGGGCGCAGACGGTTATTCGATTTTGGACAC
TACGCTGCTGGATCAGCACTTCGGGACCATCCAAACCTGGAGAAATGCAATCACAGAGATTCACAAGCGTGGGATGTACG
TCTTATTCGACAACACTATCGCTACGTGAGTCTGCTGGTTTTCCAAGTCAAATGCGCGAATGCTAACTACACCCAAGGAT
GGGCGATTTGATCGGATTCAAAGGTTATTTGAACGTTAGCGCCCCGTTCTCTGTCAAAGAGCACGAAGCTGTTTGGAAGT
CTGACCGTCGCTACGTCGATTTTGATTTTGGAAACACCTACAATCAGACCTGCGAGTACCCTCGATTCTGGAACGAGACT
GGCTGGCCCGTTGATAAAGACGTTCGTGATGAGCTACAAGGTTGCTATAGTAGTGATTTCGATCAATACGGTGACAGGGA
AGCTTTCGGTGTATATCCAGACTGGCAGCGACAGCTGGCCAAGTTTGCATCAGTCCAGGATCGTCTCCGTGAATGGAACC
CAAGCGTTCGCGAGAGACTAATCAGACATTCCTGCATGATTTATCAAAGCTCTTGACATTGACGGATTTCGCTATGACAAA
GCCACGCAGGCCACAGTGGACGCCCTTGGAGACATGTCGAGTGCTTATCGTGAGTGTGCCCGTGAGGTCGGTAAAAACAA
CTTTTTCCTCCCAGGTGAGATTACTGGTGGAAACAATTTCGGCTCGATCTATCTCGGACGAGGAAGACAGCCCAACCAAT
ACCCAGACTCTGCTATGGATTCTATGGCCATGAACAACGAGTCGGATCACCAATATTTTCTTCGTGAAGATGGTTTACAG
GCGGCTCGATAGCGCTGCCTTCCACTACTCAATCTATCGATCCCTCACCCGGTTCCTTGGCCTCGACGGAAATCTTGCTGC
TGGTTACGATACGCCGATTGACTGGACAGATGCCTGGAATGTAATGGTGATGACCAATGACATGATAAACGCGAATACCG
GTAAATTTGACCCGCCGACACATGTTTGGTGCCACGAACCAGGATGTTTTTCGTTGGCCAGCCATCAAACAGGGTATCGAA
CGCCAACTCCTGGCGATGTTCATTACAACACTTCACCTCCCGGGTATTCCAATATTGTTGTGGGGTGAAGAGCAAGGTTT
CTATATCTTGGACGCCACTGCAGACAACTATGTCTACGGCCGCCAGGCGATGTCACCAGCCACAGCTTGGAAAACCCATG
GATGCTTCCAATTGACAGCAGATCAGTACCACAACTGGCCTATCAGCAAAGGACGTGAAGGCTGTCATGACGAGACAGTA
ACCTATGACCACCGCGACCCGTCTCATCCGCTCCGAAATATCATCAAACATATGTACCAGTTGCGACAAGATTACCAGGT
TTTGAACGACGGATATTCTGTCCAGAAACTCTCCAATCAAACCCGCCAGATTTTCTATCCAGGCTCGAACGGAACGGCTA
CGGAGACCGGAATGTGGTCTGTCTTACGAGACTCAGTTTACAAGATCCAGGAGCTACACAACGAGCAACCGGTTTGGCTT
GTATACCAGAATGACAACAAGACGGTGGAATACAATTTTGACTGCAGTGATAATGACACGGCGTTGATATCCCCCTTTGC
CACCAAAACCACGGTTGTCAATCTCTTTTACCCGCATGACGAATATGACTTGAAGGACGGTCCAAAGAAGCTCCATCTTA
ATGGCTCAGCGGAGTTCAATGGATGCCTTGATAGCATGACGCTGAAGCCTTTCGAATTCAAGGCTTTCGTTCCGAAAGAG
CGATTTGTGAAGCCTAGACCCATGATTACCAAAATCACACCAGGACACGACCAACCGATCATTTCCAAAGTCGTGGCGAG
CGAGGCAGAGGATCTTGATTTGAGCATTTACTTCTCTGCGGAGATGGACTGCGACTCAGTCACAAAAGCGATCAAAGTGC
AGTCCACCACAGAAGTCAATAAGACAGCTTTGATTGACAAAGACAGCGTGAAATGCAGGAGGATTGATCCAAACGAAACG
CGGTGGACTGCCCAGCTACCCAGCGTCTGGGCGTGGTCGTCAAAGTTGACCGGAGTATACAATGGAATTCATCGGCTGAC
CGTCACCAATGCCACCAGCGAGGTTGGAGGCTCAACACAGGCTGTTGATCACTTTCTCATTCGCATTGGTCAAATAGACA
ATCCCATGGTCTTCACCAGGGCCAATTACTCCACTGACCTACTTCACCAGCAGGAGAACGGAACACTCTATATTCGACAC
AAAGCCGCTGGTGCTGATAAATATCGTTATTCCACCAATTGGGGAAGCTCTTTTTCAAACTGGCGCGAATACAAAGGTGG
CGACGAATTCATTGAAGAACAACCATGGTCCGGAACTAAAAAGCAGAAATGGAATGGGAAGCATGTCCGCGTTGAGTACT
GGAGCAAGTTGACTGGTAGCAGCAGCTATGTCCAAGAAGGTGACTATGATACCAAGCATCAAAGACGCTTCCCGCACCTC
TTCTTCAATGGGCCTTACAACCAGTATGGATACGATGCAGGACTGGACAATGAGGTGAAACAGGACAGTGACGGGTACTG
GAAATATCGGCTCCGAGCGGAATTCCCTGCTCAGGGACAGTTTAATGTTTGGGGTATGAACCCAGACGGGAAGCCCGACC
AGAGTTTTGTGTTTGGTGATCTTGATTCTGACGGTGTTTTGGACCGGCATGCCACCATCCTCCCTGAACACCCTTTCTATT
AACGTCACCGACAGGCCACCGTCGTCCTATCTATCTTGGAATATTTGGGTCGATGACGGTACCATGAGCATCCAGTTTCA
ACCGACTGGCTCGAGGACAATCCAGATGGTAGTTTATTTCTTGCTTTGGTTCGTACCGCTTGTGACAGCTATCGGATGCG
TATATGCTTTCATGAAATCGTTTTACCAGGTCAAATTCAACCAGATTGGAATCAGCCAGAAGCGGTCATTATTCGGTTTC
TCAGTCGGCCGGAAGCCTTCATTGAATCCACTGACGCGGCTTGCCAATAAATCCGGATTTCTCCAAAGCACGCCTGTCTT
TGGAACAGGGTCTTCTCGCAGGCGCAGTGTTCTCATCGCCACTATGGAGTATGACATTGAGGACTGGGGTATCAGGATTA
AAATTGGTGGTCTTGGAGTCATGGCACAGCTCATGGGCAAGAACCTCGGGCATCAAGATCTCATTTGGGTTGTCCCATGT
GCGGGGGACGTAGACTACCCAGAGGATCAGCCAGCTGAGCCAATGTTTGTGACTGTTCTCGGGAACATCTACGAAGTCAA
GGTTCAGTATCATGTCCTGAACAATATTACATATGTTCTTCTCGATGCGCCCGTTTTCCGTCAACAGTCAAAGGCTGAGC
CCTACCCTGCTCGCATGGACGACCTTGATAGTGCGATATACTATTCCGCCTGGAATCAGTGCATTGCTGAGACCATCAAG
```

Fig. 17

```
CGCTTCCCTATCGACCTTTATCATATCAATGATTATCATGGTTCTATTGCGGCTCTCTACCTTCTTCCCCAGACGATCCC
TGTTTGTCTTTCGCTTCACAACGCCGAATTTCAGGGTCTCTGGCCCATGCGCACACAAAAGGAAAGGGATGAGGTTTGCT
CTGTTTTCAATATCGACGTCGATGTCGCCAGGCGATATGTCCAATTTGGCGAAGTTTTTAACATGCTCCATGCCGGTGCT
AGCTACCTTCGTGTCCACCAACAAGGGTTCGGCGCTGTAGGTGTTTCCAGGAAATATGGAAAACGCTCGTACGCGCGCTA
TCCCATCTTCTGGGGTCTCAAGAAGGTTGGGAATCTTCCGAACCCAGATCCTTCTGACACGGCTGAATGGAACAAGGAAC
TGCCTAAAGAAAGTGAGATCCAGGTAGACCAGAACTACGAGGCAAGCAGGGCAGAGCTGAAACGGCAAGCGCAGGAATGG
GCGGGCCTTGAACAAAACCCTAATGCTGACCTTATGGTTTTCGTGGGACGGTGGTCGATGCAGAAAGGAATCGATCTGAT
AGCTGATGTTATGCCCGCTGTTTTGGAGGCTCATCCCAATGTTCAGCTGATCTGTGTCGGCCCAGTCATTGACCTTTATG
GAAAATTTGCCGCCCTGAAGCTTGACCGGATGATGCAGCTCTACCCTGGGCGTGTGTTCTCAAAGCCCGAGTTTACAGCA
CTTCCTCCATACATATTTTCAGGAGCGGAGTTTGCCTTGATCCCATCCCGTGACGAACCGTTCGGACTGGTTGCCGTTGA
ATTTGGTCGCAAGGGAGCCTTGGGAATCGGTGCACGTGTTGGAGGGCTTGGCCAGATGCCGGGTTGGTGGTATAATGTTG
AATCAACAACTACTGCCCATCTGCTTCATCAATTTAAACTAGCTATCGGATGTGCCTTGAACTCGAAACCCCAAGTTAGG
GCAAGGATGCGTGCAAGATCTGCAAAGCAGCGTTTCCCTGTTGCTCAATGGGTTGAGGACCTCGAGATTCTACAGTCAAC
GGCCATGCGAATCCACAGCAAAGGCTTGGCTAAGGCGAGCGTCCAGCCCTATAACTCAGGAAGCAACACCCCACTTGGCA
TGATGACGCCCCTATTGCGTCGACTGGGACTGTTACCCCGACGGGAATCCAGACACCTCCTCTTGCCCATTCGCGATCA
GGAAGCTACTCAAACATCAACCGCCTCAGTGCTTATGGGCCTCAGCAACGTAACACGATAATCTACAGCCGAGACCCAAG
CCCAGGCGGCGAAGACCAGCCTAGATCTGGTATTCGACAGTTATCACTTGGTGTTAGGGCTGGGCCTGGACATCTTATGC
GTCGTGGCCGCCGCAGGTTGAGAAGAAATAGCCACGCGGGGACGGACGAGAACGCCAGCGTCTCCATGACGGAGGAGAGT
AGCGACGACGATATAATCCCAAGTTTCTACGGGGAAGAGGAGTACACGCTTACCCCTGAACAGGCTGAGGAAGTACGTCG
CGCAGATATGACACCACAGCAGGAACAGAATCATGGCTCGGTTAGGGACTTCTTTACCCGTCGTCACTCGAGTCAGAGCT
CGATTTTGTCTCGGTAGTGTTTTGTCTCCAGCCAGTTCGACTACGTTTGACGGGGACGAGACCTTCGTTCCACCCGCACCA
CCGTTTGCAGAACCTGGAAACCGTCTCAGCAGTGCGTCGGTACTCTCTGTTGACTCAGTAGTGGGCGAGAAGAAAGATTA
CAAACTGCAAAAAGTTGATCCTACATTTACCGATAGCACTGGCGAATTCTACAAGGTTTTTGAAAGAAAACTAGAAAAGC
TCAATGGCTCGAACTCCATCTCCCAACTTTGCATCGAGGAATATCTGGAGAAGAGCGAAAAGAAATGGTTTGACCGATTC
CGTGATGCACGACTTGGCCGCAAACAGTCCCCGTCGTCTTCCATTTTCCGCACCAAGTTTGAAGGCTCCTCGCCTATGGC
ACTCGTATCAAACGATGAAGTCGGATCGCGCGCGAGTGGAAGCGAGCCCCGTATGAGGCCTGACGAATTTTGTCTTGGAA
ACGACTATGTTCCTCCCTCTGGGCTCAAGAAGTGGATGCAAGTTCGGATTTTCGACTGGCCCATTTACTCCTTCATTCTC
GGACTGGGCCAAATTATAGCAGCGAACTCTTACCAGATCACCTTGTTGACTGGGAGAAGTCGGGCCAGCGGGCCTGAGAAGCT
CTATGGTATTGCAACAGTATACCTCGTGAGCTCTATAGTCTGGTGGTTTCTTTTCCGCTTTTGCAAATCTGTCGTGGTAC
TGTCTCTGCCCTGGCTGTTCTACGGTTTCGCCTTTGTTCTTATTGGAGTCGCACACTATGAGGGCGATAGCTTCGCTCGT
GCTTGGATCCAGAACGTTGGAGCCGGTGTATACGCCGCTGCATCAGCCAGTGGCTCATTGTTTTCGCCCTTAACTTCGG
AGACGAAAACGGTGCACCAGTCAAGAATTGGGTGTGGCGTGCTTGCATCATACAAGGTACCCAGCAAGCCTACATCATCG
GTCTTTGGTACTGGGGGACTTCTATATCGCAAGCAGTCACCAGAGGCGTTCCGGATGTTCAAGCCCATATCACGGAGACA
TGGAGAATGACGTACGTGCCTCCATACTCTCCAACGGTCCTTTACTAACTCTATATTGCAGTACTATCTGTATGCCGATA
GCAGTCTTTCTCTGGGTACTCGGCATCCTTGTCTTCTTTGGCCTACCAAACTATTACCGCCAGACGCCTGGAAAAGTCCC
TTCGTTCTACCAATCTGTCTGCCGTCGGAAGATCATCCTCTGGAACTTCGTAGTGGTCATTCTGCAAAATTTCTTCCTCA
GCGCCCCCTACGGACGAAACTGGAGCTGTAAGTCCCAAAAAAATCACTTTATTGTTCCGAAACTAAACTAAGGAAACAGT
CCTCTGGAGCTCCGTCCACGCGGAACCCTGGCACATCGGCCTTCTGGTCGTCGCCTTCTTCGGAGTCGCCTGGGTTCTCA
TCCTCTGTATCTTCGCCCGGCTTTCCAAATCCCACAGTTGGATCCTCCCCGTTTTTGCCTGCGGTCTTGGTGCCCCGCGA
TGGGCACAGATCTGGTGGGGGGTCTCGGGAATGGGCTTATTCCTCCCTTGGGCAGGAAGCTACACGACCGGCGCACTAGT
ATCTCGCTCTCTCTGGCTATGGCTGGGTATTCTCGACTCCCTGCAAGGCTTAGGCTTTGGTATGATTCTATTACAAACAC
TCACACGGATGCATATCTGCTTCACGCTTTTGGCGAGTCAAGTCCTAGGCTCTATTGCGACGATCTGCGCCAGGGCTTTT
GCGCCGAATAATATCGGGCCAGGGCCCATCTCTCCTGATATTACGGATGGAGCGGGCGCCGTTGCAAACGCGTGGTTCTG
GATTGCGTTGTTCTTCCAGTTGTTGATTTGGTATGTCTTCCTACTATATAATTGGAGCCTAGTGGGACGTAAACTAATAG
TTCGATCTAGTGCTGGGTTCCTCATGTTCTTCCGGAAAGAGCAGCTTACGAAACCCTAAATACCATCGCAACTCGACCTC
GCCATTGCCATTACCCTGGTTACTTTGTCAATTCTTGACATAATCACTACAGCCGGTAATCTACCCGGTGGCGCCCCATT
GCCTGACAATCTTGCTCTCGAATCTCTCCATTGTCCCATCAGCCTATTTACTCTACCCTTTATTGATCTTGCTGTCCATC
GACAGACCGTGCATATTTGCAACTTCTTGACGATATTTGACCTCACCTCTTGAACGAAAAGAATGACTGCTATGAGTCAA
CCTAATGATTGGATGTTATATGGTCTCTTATTCTTCTATGGAACTGACTTATCATTGTGCCCGCCATGACGTGATTTGAT
GTGGGTGAGATGTGGGTGATATGTACCTAATGATACTACTTTGTTGATTAGTTCCTTCCCTATTGATGTTATGTCATAA
```

Fig. 18
PUTATIVE AMINO ACID SEQUENCE OF Aspergillus nidulans AgsB (Genbank accession No. AN3307)

MGRLQLSSGLKAIALLTFAATATCWPYDESLVDYNVNTNKSATNPADYWGEWSDHKYHPSPENWRFPFYTLFMDRFVNGD
PTNDNINGTTFEHDLNSNQMRHGGDVAGLVDTLDYLQGMGIKGLYLAGTPLMNQPWGSDGYSALDTTLLDQHFGTIQVWR
DAITEIHKRGMYVLFDNTIATLGDLIGFEGHLNDTTPFSEKEHKALWKSNRRYVDFDIGNTYNATCDYPRFWYEDGMPVN
ESLTAGLVGCYDSDFDQYGDIEAFGVWPDWKRQLAKFASVQDRLREWYPPVRERLIRHTCMIIASFDIDGIRYDKATQAT
VDALGDMSKAYRECARAVGKENFFIAGEITGGNTFGSIYLGRGRQSNQVDSVGNIYDAMKLTNESDPQLFLREVGHEAID
AGAFHYSTYRALTRFLGMDGQLEAGYDVPLDWVGAWGNMTVTNDLINANTGKFDPRHMYGVTNQDVFRWPAIEWGVERQM
LGSFITTLMLPGIPLLLWGEEQAFYVLDATASNYIYGRQAMSSATAWKTHGCFSLESSQYYGWPLVAALDGCNDETVTYD
HRDPSHPVRNIIKHMYQMREQYPMLNDGFIIETLSNQTEPVYYPGSNGTETETGMWSVRRDRNEETQDFGSSDDNEPIWL
VYSNMNRTHDYTFDCSDNETALIAAFPSGTKVRNLFHPYDTLTLGDGPKEMVYGNSTELVGCLPNLTLSRYEFRAYVKNE
LWKKPRPMITKFQPGDDEANGHDSPLRSTVAPDASETVRLTLQFSEAMGCDSVTDSISFNSSTETGKIPSIDASTVQCGN
ITEVANSNATGHIPGKWQWAADLRGVYNGIHRVTVNNASNADGDDSTHAVDHFLFRIGQIDNPMVFTSANYSSSLLHEKE
DGTFYIQHHAAGADKYRYSTNWGTTFSDWKTYKGGNDTITMLPWNGTKAQEWEGHHIRVEYWSRWTGSSSHVQEGDSGWK
YKTPRRFPHAFFNGPYNQYGYDGGLDNQIKLDAGAGGDGYWKYHFTSEWPAVGQVNVWGINPDGEPDQSWVMGDVDGDKV
LDRMPPSALSATLINITDHPTHPYISWKLYINDATMRYYLIPAGHQSGQIAMFVLFWIIPLLSGSACVYIFMKSFYKVKF
NEIGAAGASTEMKSLVPLALRRRMKQLASGNGKNGPSFNPLMRLAEKSGFMQSTTALAGAASGKRRMVLIATMEYDIEDW
GIKIKIGGLGVMAQLMGKTLGHQDLIWVVPCVGGVDYPVDTPAEPMTVTILGQAYQVNVQYHVLKNITYVLLDAPVFRQQ
TKSEPYPARMDDLDSAVYYSAWNQCIAEAIKRFPVDLYHINDYHGSVAPLYLLPGTIPACLSLHNAEFQGLWPMRTQKEK
EEVCSVFNLDVEVVRNYVQFGEVFNLLHAGASYLRVHQQGFGAVGVSKKYGKRSYARYPIFWGLRKIGNLPNPDPSDVGE
WTKEDSLIKDEDIKVDPEFEAGRAELKRQAGEWAGLDQNPDADLLVFVGRWSMQKGVDLIADVMPAVLEARPNVQLICVG
PVIDLYGRFAALKLDRMMKVYPGRVFSRPEFTALPPYIFSGAEFALIPSRDEPFGLVAVEFGRKGALGIGARVGGLGQMP
GWWYNVESVSTSHLLMQFKLAIEAALSSKTETRAMMRARSAKQRFPVAQWVEDLEILQSTAIGVHEKEVSRGHAGGRPMT
PMTPSGATTPSGMMTPTTGSRGLKPLSQGVGMGLSVPHSRESSYSNLNRLSEYVAQKTPGESQPRESSGLQRSLSLGVRS
GPGHRGRARKQKPGADNIPEGNEDGSSSDTESIPDYYDDEYTLTPAQIEESRRAQATRSISFSPETLQPPRSPLPAPPMS
PGTPPSVEQTLLPPPKPFAAADAGNRLSSASVLSLDSVVGGKKDFKLQKVDPFFTDSNGEYARNFEQQLENLNGSNSESQ
LCIEEFLVKSERRWFNKFRDARLGRLRSPTPSVFRDNHSHGRGSPDGSMYVDEAGHRNSGDAVHDNGSDDTDDEFLLGKD
YVPPTGLKKWNQIKIGDWPVYTLFLALGQIIAANSYQITLLTGEVGQTAEKLYGIATTYAITSALWWLVFRYFKSIVCLS
TPWFLYGIAFLFIGSAHFESDSFTRGWIQNVGSGFYAAASSSGSIFFALNFGDEGGAPVSKWIFRACVIQGIQQVYVIVL
WYWGSTMAHQSSQGLLTADNTISNTWKMTAICYPIAMLLWAIGLLLIFGLPNYYRQKPGKVPSFYKSLFRRKIVLWNFVA
VILQNFFLSAPYGRNWSFLWTSSHTKPWQIVILCVIFFGLLWCAFLYIVAVLSKQHSWFLPVFACGLGAPRFLQIWWGVS
GIGHYLPWVAGGYTGGALVSRSIWLWLGVLDSIQGLGFGIILLQTLTRMHMCFTLIVSQVLGSIATIVARACAPNNVGPG
PVSPDITKGAGELANAWFWVALFCQLLVCAGFLLFFRKEQLAKP

Fig. 19
BASE SEQUENCE OF NUCLEIC ACID MOLECULE OF Aspergillus nidulans agsB (Genbank accession No. AN3307)

```
ATGGGGAGGCTCCAGCTCTCAAGCGGGCTGAAGGCCATAGCCCTGCTCACATTCGCAGCGACAGCAACATGCTGGCCATA
CGACGAGTCCCTCGTTGACTACAACGTCAACACGAATAAGTCGGCCACTAACCCCGCCGACTACTGGGGAGAATGGTCGG
ATCACAAGTACCATCCGTCGCCAGAGAACTGGCGGTTTCCGTTTTACACACTCTTCATGGACAGATTCGTGAATGGGGAT
CCAACAAATGATAACATCAACGGGACCACGTTTGAGCACGATCTCAATTCAAATCAGATGCGTCATGGCGGTGATGTTGC
TGGGCTGGTTGATACGCTGGATTACTTGCAAGGGATGGGGATCAAGGTGCGTTGCCGCTATTATTCGTCAATTTCTGGTA
AAGATATAGTTGATGCTAACGATGCGATAGGGACTGTACCTTGCTGGAACTCCGCTCATGAACCAGCCCTGGGGCTCGGA
TGGGTATTCGGCGCTCGACACCACCCTTCTCGACCAGCACTTTGGCACGATCCAGGTCTGGCGCGACGCCATCACCGAAA
TCCACAAACGGGGGATGTACGTTCTGTTCGACAATACAATCGCTACGTGAGTACCTCGCCTCCCTGCGTTTTGCCATCGG
TTTGTAAAAAACTTGGGCCTGACACTAGATTACTGCAGCCTCGGTGATCTCATTGGTTTTGAAGGTCATCTCAACGACAC
CACGCCCTTCTCCGAGAAAGAACACAAGGCCCTTTGGAAGTCCAACAGACGGTACGTCGATTTCGATATTGGCAACACCT
ACAACGCCACCTGTGATTATCCGCGCTTCTGGTACGAGGACGGGATGCCAGTCAATGAGTCCCTGACCGCGGGCCTGGTC
GGGTGTTATGATAGTGACTTTGACCAGTACGGTGACATCGAAGCGTTCGGTGTCTGGCCAGACTGGAAGCGTCAACTGGC
GAAGTTTGCGTCCGTCCAGGATCGGTTGAGAGAATGGTACCCACCTGTACGGGAACGGCTGATCCGACACACATGCATGA
TCATTGCCTCCTTTGATATCGACGGTATTCGGTACGACAAGGCGACCCAGGCGACTGTCGATGCGTTGGGGGACATGTCC
AAAGCGTATCGGGAATGCGCGCGGGCTGTCGGCAAGGAGAACTTTTTCATTGCGGGTGAGATCACAGGAGGCAATACTTT
TGGGTCTATCTATCTGGGACGAGGACGGCAGTCGAACCAGGTCGATTCGGTGGGGAATATCTACGACGGCCATGAAACTGA
CAAACGAGTCGGATCCGCAGCTTTTCCTGCGCGAGGTCGGCCACGAGGCTATCGACGCCGGTGCCTTCCATTACTCGACT
TACCGTGCCCTGACCCGCTTCCTGGGAATGGACGGGCAGCTGGAGGCCGGTTATGACGTCCCTCTTGACTGGGTGCAGGC
ATGGGGAAACATGACCGTGACCAACGACCTGATTAACGCCAACACGGGCAAGTTCGATCCCGGCACATGTACGGCGTGA
CAAACCAGGATGTTTTCCGTTGGCCGGCAATCGAGTGGGGTGTTGAGAGGCAGATGCTGGGCTCGTTTATCACCACGCTG
ATGCTGCCGGGCATCCCGCTGCTGCTTTGGGGAGAGGAGCAAGCGTTCTACGTGCTCGATGCGACGGCGTCAAACTACAT
ATATGGACGACAGGCCATGTCGTCTGCGACCGCGTGGAAGACGCACGGCTGCTTCTCACTCGAATCGAGCCAGTACTACC
AGTGGCCCCTGGTGGCCGCACTCGACGGTTGCAACGACGAGACGGTCACGTACGACCACCGGGACCCGAGCCACCCGGTG
CGCAACATCATCAAGCACATGTACCAGATGCGCGAGCAGTACCCAATGCTCAACGATGGGTTCATCATCGAGACCCTTTC
TAACCAGACGGAACCTGTCTACTACCCCGGTTCCAACGGGACCGAGACCGAGACAGGCATGTGGTCGGTCCGCCGTGACC
GGAACGAAGAGACCCAGGACTTTGGCTCGAGTGACGACAACGAACCCATCTGGCTAGTCTATAGCAACATGAACCGCACG
CACGACTACACATTTGATTGCTCTGACAATGAGACGGCACTCATTGCCGCCTTCCCCTCAGGCACCAAGGTCAGGAACCT
CTTTCACCCGTACGACACGCTGACCCTAGGCGACGGGCCAAAGGAAATGGTCTATGGCAACTCGACTGAGCTGGTAGGCT
GCTTACCGAACCTGACGCTTAGCCGGTACGAGTTCCGTGCCTATGTCAAGAACGAGCTCTGGAAAAAGCCCCGGCCGATG
ATCACCAAGTTCCAGCCCGGCGACGATGAGGCCAACGGCCACGACAGCCCGCTGCGTTCGACCGTCGCACCAGATGCGTC
CGAGACGGTGCGACTGACGCTGCAGTTTTCTGAGGCGGATGGGATGCGATTCTGTCACAGACTCCATCTCATTTAACTCTT
CCACGGAAACCGGCAAGATTCCATCCATCGACGCCTCCACCGTCGAGTGTGGGAACATGACTGAAGTCGCCAACAGCAAC
GCTACCGGGCACATCCCCGGTAAGTGGCAGTGGGCTGCAGATCTGAGAGGGGTGTACAACGGCATCCACCGGGTCACTGT
CAACAACGCCAGCAACGCCGACGGGGACGACTCCACCCACGCAGTCGACCACTTCCTCTTCCGGATTGGGCAGATTGACA
ACCCGATGGTCTTTACCTCTGCCAACTACTCCAGCAGTTTGCTGCATGAGAAGGAGGACGGCACGTTCTATATCCAACAC
CACGCTGCCGGTGCTGACAAGTACCGCTATTCGACGAATTGGGGCACCACGTTCTCTGACTGGAAAACGTACAAGGGAGG
TAACGACACGATTACCATGCTTCCATGGAATGGCACTAAGGCGCAGGAATGGGAGGGACATCACATCCGCGTCGAGTACT
GGTCCCGCTGGACTGGCAGCAGTAGCCACGTCCAGGAAGGCGATTCCGGCTGGAAGTACAAGACGCCACGTCGCTTCCCA
CATGCCTTTTTCAATGGGCCCTACAACCAGTACGGGTACGACGGCGGTCTGGACAACCAGATCAAGCTGGACGCGGGCGC
CGGCGGCGACGGATACTGGAAGTACCATTTCACCTCGGAGTGGCCTGCCGTCGGGCAGGTGAATGTCTGGGGCATCAATC
CGGATGGCGAGCCCGATCAGAGCTGGGTGATGGGCGACGTGGACGGGGACAAGGTCCTCGACCGCATGCCACCAAGCGCG
CTCTCTGCAACGCTGATTAACATCACTGATCACCCAACGCACCCTTATATCTCGTGGAAGCTGTACATAAACGACGCGAC
GATGCGGTACTATCTCATCCCCGCTGGCCACCAGAGCGGGCAGATCGCCATGTTCGTCCTCTTCTGGATCATCCCTCTCC
TGTCCGGCTCCGCCTGCGTCTATATCTTCATGAAGTCCTTCTACAAGGTCAAATTCAACGAAATCGGCGCTGCCGGCGCA
AGCACGGAAATGAAGTCACTTGTCCCGCTTGCTCTCCGTCGACGCATGAAGCAGCTCGCCTCTGGGAATGGCAAGAACGG
TCCGTCATTCAACCCGCTCATGCGCCTTGCTGAAAAGTCGGGCTTTATGCAGAGCACGACTGCGTTGGCCGGTGCGGCCT
CGGGCAAGAGACGCATGGTCCTGATCGCGACCATGGAATACGATATTGAAGACTGGGGGATCAAGATCAAGATCGGTGGT
CTGGGAGTGATGGCCCAGCTGATGGGTAAGACACTCGGCCACCAGGACCTTATCTGGGTGGTGCCTTGTGTCGGGGGCGT
```

Fig. 20

```
GGACTATCCTGTTGATACCCCTGCGGAACCCATGACGGTCACTATCCTGGGTCAGGCATACCAGGTGAACGTGCAGTACC
ACGTTCTGAAGAACATCACGTACGTCTTGCTTGACGCGCCCGTCTTCCGCCAGCAGACCAAGTCGGAGCCGTACCCAGCG
CGCATGGATGACTTGGACTCTGCAGTGTATTACTCCGCATGGAATCAGTGTATCGCAGAGGCGATCAAACGGTTCCCTGT
TGATTTGTACCATATTAACGATTACCACGGCTCTGTCGCGCCGCTGTACCTCCTGCCAGGTACCATCCCCGCCTGTCTGT
CACTTCACAATGCCGAGTTTCAGGGTCTATGGCCGATGCGAACACAGAAGGAGAAAGAGGAGGTCTGTTCCGTGTTCAAC
CTGGATGTTGAGGTTGTCCGCAACTACGTCCAGTTTGGTGAGGTGTTCAACCTCCTCCACGCAGGAGCGAGCTATCTCCG
CGTTCACCAACAGGGCTTTGGTGCCGTCGGTGTCTCGAAGAAGTACGGCAAGCGTTCATATGCTCGGTACCCGATCTTCT
GGGGCCTGCGCAAGATCGGAAACCTGCCGAACCCCGATCCGTCTGATGTGGGCGAGTGGACGAAGGAGGACAGCCTGATC
AAGGACGAGGATATCAAGGTGGATCCAGAGTTTGAAGCAGGCCGCGCTGAGCTCAAGAGACAGGCGCAGGAGTGGGCTGG
GCTGGACCAGAACCCTGATGCTGACCTCCTGGTTTTCGTCGGTCGTTGGTCCATGCAGAAGGGTGTTGACCTTATCGCAG
ACGTTATGCCCGCAGTCCTTGAAGCACGACCAAACGTACAGCTCATCTGTGTTGGACCTGTTATCGATCTCTATGGCCGC
TTTGCGGCGCTCAAGCTCGACCGGCATGATGAAGGTGTATCCCGGCCGCGTCTTCTCACGCCCTGAATTCACTGCCCTGCC
GCCGTATATCTTCTCCGGCGCGGAATTCGCGCTTATTCCCTCCCGTGACGAACCCTTTGGTCTTGTCGCCGTCGAGTTTG
GCCGCAAAGGTGCGCTCGGCATTGGAGCCCGTGTTGGTGGACTGGGACAGATGCCTGGATGGTGGTACAATGTCGAATCG
GTCTCGACATCCCATCTCCTCATGCAGTTCAAGCTCGCTATTGAGGCTGCCCTTTCGTCAAAGACTGAGACACGTGCTAT
GATGCGTGCTCGCTCTGCTAAACAACGCTTCCCCGTTGCGCAGTGGGTGGAAGATCTGGAGATCCTACAGTCGACTGCTA
TCCAGGTTCATGAGAAGGAGGTTTCCCGTGGTCATGCAGGTGGCCGCCCCATGACACCGATGACGCCCTCTGGAGCTACG
ACGCCCAGCGGAATGATGACGCCTACTACAGGATCCCGTGGTCTTAAGCCTCTGTCCCAGGGCGTCGGCATGGGCCTCTC
GGTGCCACACTCCCGGGAGAGCAGCTATTCGAACCTCAACCGATTGAGCGAGTACGTTGCGCAAAAGACTCCGGGCGAGT
CTCAACCGCGAGAATCGTCCGGTCTGCAGCGCTCGCTCTCGCTCGGTGTCCGGTCCGGTCCTGGCCACCGTGGTCGTGCG
CGCAAGCAGAAACCCGGCGCGGACAACATCCCGGAGGGCAACGAGGACGGCAGCAGCAGTGATACTGAGTCTATCCCTGA
CTACTACGACGACGAGTACACCCTCACCCCAGCTCAGATTGAAGAAAGCAGACGGGCTCAGGCCACCCGTTCCATATCCT
TCAGCCCCGAGACACTCCAGCCACCTCCGATCTCCCCTGCCCGCACCTCCCATGAGTCCCGGGACGCCACCGTCGGTTGAG
CAGACTCTGCTGCCTCCACCAAAGCCCTTCGCTGCCGCTGACGCTGGAAACAGACTTAGTAGTGCATCAGTGTTATCCCT
AGACTCTGTCGTGGGTGGGAAGAAAGACTTCAAGCTCCAAAAGGTCGACCCCTTCTTTACTGACAGCAACGGCGAGTATG
CTCGGAACTTCGAACAGCAGCTCGAGAACCTCAACGGCTCCAACTCCGAGTCACAGCTGTGTATCGAGGAGTTCCTTGTC
AAATCGGAACGCCGCTGGTTCAACAAGTTCCGCGATGCAAGGCTGGGTCGTCTGCGCTCGCCCACACCGTCTGTCTTCCG
CGACAACCACAGCCACGGCCGGGGCTCGCCCGATGGATCTATGTATGTGGATGAGGCAGGCCACCGTAATAGTGGCGATG
CCGTGCACGACAACGGCTCAGATGACACAGACGATGAGTTCCTCCTAGGCAAAGACTACGTGCCTCCCACGGGCCTGAAG
AAATGGATGCAGATCAAGATCGGCGACTGGCCGGTGTACACGCTCTTCCTCGCACTGGGCCAGATCATCGCTGCAAACTC
CTACCAGATCACGCTGCTGACAGGCGAAGTCGGCCAAACAGCCGAGAAACTGTACGGAATTGCCACAACCTATGCCATAA
CCTCAGCCCTCTGGTGGCTCGTCTTCCGGTACTTCAAATCCATCGTCTGCCTCTCCACCCCCTGGTTCTTGTATGGAATT
GCGTTCCTCTTCATTGGCTCCGCGCACTTTGAGTCCGACTCATTCACCCGCGGCTGGATCCAGAATGTCGGCAGCGGCTT
CTATGCTGCGGCTTCCTCCAGCGGATCCATCTTCTTTGCGCTGAACTTCGGTGATGAGGGCGGTGCACCAGTGAGCAAGT
GGATTTTCCGTGCATGTGTGATTCAGGGCATCCAGCAGGTCTATGTCATTGTGCTCTGGTATTGGGGTTCCACGATGGCA
CACCAGTCCAGCCAGGGTCTGCTCACGGCCGGATAATACGATCTCAAATACGTGGAAGATGACGTACGTCCAAAACGACCC
TAAATTACCCCCAATTAATATACAGAACTCACTAACAAACTGATACAGCGCCATTTGCTATCCGATCGCCATGTTACTGT
GGGCCATCGGCCTCCTGCTGATCTTCGGCCTACCAAACTACTACCGCCAGAAACCCGGCAAAGTACCCTCCTTCTACAAA
TCCCTTTTCAGACGCAAGATCGTGCTCTGGAACTTTGTCGCCGTCATCCTACAGAACTTCTTCCTGTCGGCTCCCTATGG
CCGCAACTGGAGTTTCCTCTGGACATCCTCCCACACAAAGCCCTGGCAGATTGTCATCCTGTGTGTCATATTCTTTGGTC
TTCTGTGGTGCGCGTTCCTTTACATTGTCGCTGTTCTTTCGAAGCAGCACTCCTGGTTTTTGCCAGTCTTCGCATGCGGG
CTCGGCGCCCCCGCTTCCTGCAAATCTGGTGGGGTGTTTCTGGCATCGGACACTACCTTCCCTGGGTTGCCGGCGGGTA
TACTGGCGGCGCACTAGTTAGTCGGAGTATCTGGCTGTGGCTAGGTGTGCTAGATTCAATCCAGGGGTTAGGGTTCGGAA
TCATTCTCCTCCAAACCCTGACCCGGATGCATATGTGCTTTACGTTGATCGTCAGCCAAGTCCTGGGATCTATAGCAACC
ATCGTTGCGAGGGCATGTGCTCCAAATAATGTTGGTCCGGGACCTGTGAGTCCAGATATCACGAAGGGAGCGGGCGAACT
GGCGAACGCCTGGTTCTGGGTTGCATTGTTCTGTCAGTTGCTTGTCTGTGCTGGGTTCTTACTGTTTTTCCGCAAGGAGC
AACTTGCGAAGCCTTAA
```

Fig. 21
PUTATIVE AMINO ACID SEQUENCE OF Aspergillus sojae AgsA

MKWGFTGSLLALLAATAAGWPYDESLVDYNLNVNKDTTNPAEYTHAEWKGHTYHPSPESWRFPFYTLFIDRFVNGDPTND
NINGSLFEHDLNSNQMRHGGDAAGLVDTLDYLQGMGIKGIYLAGTILMNQPWGSDGYSILDTTLLDQHYGTIQTWRDAIT
EIHKRGMYVLFDNTIATMGDLIGFEGYLNTTTPFSVKEHKALWKSDRQYIDFRFDNEYNNTCEYPRFWNETGYPVDKDVT
DELVGCYNSDFDQYGDREAFGVYPDWERQLAKFASVQDRLREWHPSVKERLIRHSCMIIKALDIDGFRYDKATQATVDAL
GDMSHAYRECARSVGKDNFFIPGEITGGNNFGSIYLGRGRQPNQYPDSSLASMNLTNTSDHQYFLRDHGLQALDSAAFHY
SVYRTLTRFLGMDGNLAAGYDTPLDWTDSWNIMVLSNDMINANTGKFDPRHMYGTTNQDVFRWPAIELGVERQLLGHFIT
TLHLPGIPILLWGEEQAFYILDSTADNYIYGRQAMSPSTAWKTHGCYSLGSSQYYNWPISAGREGCHDEAVAYDHRDPSH
PLHNIIKHMFQMRQDFPVLNDGYSVVKLSKQTHEIQYPGSNGTATEVGVWSVMRDIVSNIQDFGDSGNNEPVWLVYQNDN
KTVEYSFDCGSNDSALISPFTTGTTVVNLFYPHDEHELKDGPKSLHLNGTNATNGCLDSLKMKPFEFRAYVPKANFVKPR
PMITQFEPGHDVPQLSKVGPDESEDIDVSIYFSTKMDCDQVTKSISFESSTEAGKTPSISNNSVSCKDAKGDDPKWTGQI
PNAWVWTAKLTGVYNGIHRLTVKNATSSDGHSSTQATDHFLIRVGQRDNPLVFTSANYSTSLLNQYDNGTLYIQHRAAGA
NKYRYSTNFGSSFSDWKDYHGGNDTIEELPWSGTDKQKWQGKHVRVEYWNKLTGSSDYAQEGDSGYDHPRRFPHLFFNGP
FNQYGYDAGLDNVVRQDSDGLWKFRFMAEFPAQGQFNVWGMNPDGQPDQSYVFGDIDDDGVLDRMPPSSLSSTIINITDI
PPSPYLAWNLGVDDGTLRVHLLPTGSRTIQMVVYFLLWFVPLVTAIACVYAFVKSFYQVKFNQVGVSEKKSILPLAFRRK
MNPDGSGGSINPFMRLANKSGFLQSTPAFGAVASRRRTTLIATMEYDIEDWAIKIKIGGLGVMAQLMGKHLGQQDLIWVV
PCVGGVDYPVDQPAEPMFVTVLGNSYEVQVQYHVLNNIKYVLLDAPVFRQQTKSEPYPARMDDLDSAIYYSAWNQCIAQA
IRRFPIDLYHINDYHGSIAPLYLLPQTIPVCLSLHNAEFQGLWPMRTQKERDEVCSVFNLDLDTAKRYVQFGEVFNMLHA
GASYLRVHQQGFGAVGVSRKYGKRTYARYPIFWGLKKVGNLPNPDPSDTGEWNKELPKDSEIQVDANYEASRGELKRQAQ
EWAGLDQNPDADLLVFVGRWSMQKGVDLIADVMPAVLEARPNVQLICVGPVIDLYGKFAALKLDHMMRLYPGRVFSKPEF
TALPAYIFSGAEFALIPSRDEPFGLVAVEFGRKGALGIGARVGGLGQMPGWWYNIESTTTSHLLHQFKLAIGSALNSKPQ
VRAKMRARSAKQRFPVAQWVEDLEILQTTAMRIHSKGQAKSNGGPLSPSGYNTPSEVITPSGMMTPTIASTGTTTPTGMQ
TPPIAHSREGSYTNLSVNRDSAYGPQQRNTIVYSRDPSPGGNDEPRLSLGRQLSLGFRAGPGHINLRGRRLKRRSQMGNE
ESGTATEESSDDDYFRGEEEVTITREQADEGRHQRNPLRSLASPTNSYFEEGITSGRPPWAQPGNRLSSASVLSVDSVVG
EKKDYKLQKVDPFFTDGTGEYYRVFDQRLEKLNGSNSESQLCIEEYLMKSEKKWFDKFRDARLGRNQSPASSIFQTKGEN
NTPMSSISHEDLGSNESGSDPRAEKDEFLLGRDYVPPSGLRKWMQIRIFGWPVYSFFLGLGQIIAANSYQITLLAGENGQ
TAGKLYGIATVYLVTSIIWWFFRFFKSVFVLSIPWFLYGASFVIIGLAHFESNGFARGWIQNVGSGVYAAASSSGSLFF
ALNFGDESGVQVKDWVFRACLIQGTQQAYVIGLWYWGTTISSAVANGVTNVNGGIVNSWKMTAICMPIAAFLWAIGLIIF
FGLPNYYRQSPGKVPSFYKSVFRRKIVLWNFVVVILQNFFLSAPYGRNWAFLWSSNHAEAWQVGILVVVFFGVIWVAVLT
LFGYLSKRHSWILPVFACGLGAPRWAQIWWGVSGMGLFLPWAGSSVSGALASRSLWLWLGILDALQGLGFGMILLQTLTR
VHIAFTLLASQVLGSIATIVARACAPNNIGPGPISPDVTAGGSSVANAWFWIALFFQLLICAGFLLFFRKEQLTKP

Fig. 22
BASE SEQUENCE (PUTATIVE) OF NUCLEIC ACID MOLECULE OF Aspergillus sojae agsA

```
ATGAAGTGGGGATTCACTGGCTCGTTGCTTGCGTTGCTCGCAGCAACAGCAGCAGGCTGGCCCTATGATGAGTCCCTAGT
CGATTATAACTTGAATGTGAATAAGGATACTACCAATCCGGCTGAATATACTCACGCAGAATGGAAGGGCCATACGTATC
ATCCCTCTCCAGAAAGCTGGCGTTTCCCCTTCTATACCCTGTTCATTGACCGGTTTGTCAATGGTGATCCCACTAACGAT
AACATCAACGGGTCACTCTTTGAACATGATCTTAATTCAAATCAAATGCGTCACGGTGGTGATGCAGCTGGCTTGGTCGA
TACACTAGACTACCTACAAGGAATGGGCATAAAGGTTCGTGGCAATGATTTGCGTGTTGTTTCTTGCTATTGGTGTTTAC
AGCATATGGCTGACTGACCTCTACAGGGGATCTATTTGGCTGGTACTATCTTAATGAATCAACCATGGGGCTCAGACGGT
TACTCGATTTTGGATACTACCCTGCTTGATCAGCATTATGGTACAATTCAAACCTGGAGAGACGCAATCACCGAGATTCA
TAAGCGGGGCATGTATGTCCTCTTTGACAATACTATCGCAACGTAAGATGCTGCCCCTCGCCTAAGTCGTTACATTCCAG
CGCTGACATGAAACCAGCATGGGCGATTTGATTGGATTTGAAGGTTATTTGAATACTACCACGCCTTTCTCAGTCAAGGA
GCACAAAGCATTGTGGAAATCTGACCGTCAGTATATCGACTTCCGTTTTGACAATGAGTACAACAACACTTGCGAATACC
CTCGATTCTGGAACGAGACTGGCTATCCAGTCGATAAGGATGTCACAGATGAGCTAGTCGGATGCTATAACAGTGATTTC
GACCAGTACGGTGACAGAGAAGCTTTCGGTGTCTACCCAGACTGGGAGCGTCAGTTGGCCAAATTCGCTTCAGTTCAAGA
TCGTCTACGTGAATGGCACCCTAGCGTTAAAGAGAGACTTATTCGGCACTCGTGTATGATTATAAAGGCCCTGGATATTG
ATGGCTTCCGCTACGATAAAGCGACGCAGGCCACAGTGGATGCTCTTGGTGACATGTCCCATGCTTATAGAGAGTGTGCT
CGCAGTGTTGGCAAGGATAACTTCTTCATTCCTGGGGAAATCACTGGTGGGAATAACTTTGGTTCTATTTACCTCGGACG
TGGAAGACAGCCCAACCAATACCCAGACTCCTCCTTGGCTTCGATGAACCTGACGAACACCTCTGATCATCAGTATTTCT
TACGTGATCACGGTCTACAAGCGCTAGATTCAGCAGCTTTCCATTATTCGGTGTACCGTACCCTCACACGATTCCTAGGT
ATGGATGGCAACCTGGCTGCGGGCTATGACACACCGTTGGACTGGACGGACTCCTGGAATATTATGGTATTGAGCAACGA
TATGATCAATGCTAACACTGGCAAATTCGACCCCCGGCATATGTATGGTACTACAAACCAGGATGTTTTCCGTTGGCCTG
CCATCGAGCTCGGAGTCGAGAGACAGCTCTTGGGTCACTTCATCACAACCTTACATCTCCCCGGCATCCCGATTTTGCTG
TGGGGAGAAGAACAAGCCTTCTACATTCTAGACTCTACTGCGGATAACTATATCTATGGCCGTCAAGCAATGTCTCCCTC
CACTGCGTGGAAAACACACGGATGTTATTCCCTTGGTTCGTCCCAATACTACAACTGGCCTATCAGCGCAGGTAGGGAAG
GATGTCACGATGAAGCTGTCGCTTATGATCATCGAGATCCCTCTGATCCACTCGACAATATCATCAAACACATGTTCCAG
ATGCGACAGGACTTCCCTGTACTGAATGATGGATACTCAGTTGTCAAGTTGTCCAAACAGACTCATGAGATTCAGTATCC
TGGTTCGAATGGCACGGCAACGGAAGTCGGCGTCTGGTCAGTTATGCGTGATATTGTCTCCAACATTCAGGACTTTGGTG
ACAGCGGCAACAACGAACCCGTCTGGCTGGTCTATCAAAACGACAACAAGACCGTGGAATATAGCTTTGATTGTGGGAGT
AACGATTCGGCCTTGATTTCTCCATTTACTACGGGAACTACTGTTGTTAATCTCTTCTACCCACACGATGAACACGAGCT
GAAAGATGGCCCCAAATCACTTCATCTGAACGGCACCAATGCAACAAATGGTTGTCTGGATAGTTTGAAGATGAAGCCCT
TCGAGTTCAGAGCTTACGTTCCAAAGGCTAACTTTGTTAAGCCTCGTCCCATGATCACCCAGTTCGAGCCTGGTCACGAT
GTGCCGCAGCTGTCTAAAGTCGGGCCTGACGAATCAGAAGATATTGACGTTAGCATTTACTTTTCCACTAAGATGGATTG
TGATCAGGTTACGAAATCCATTTCATTCGAATCCAGTACTGAAGCTGGCAAGACTCCCTCTATCAGTAATAACAGTGTCA
GCTGCAAAGATGCCAAGGGTGATGATCCGAAGTGGACTGGTCAAATCCCCAACGCCTGGGTCTGGACAGCGAAGTTGACT
GGCGTTTACAACGGTATCCATCGCTTGACCGTCAAAAATGCAACTAGTTCGGATGGGCATAGTTCTACCCAAGCAACTGA
TCACTTCTTGATCCGAGTGGGCCAAAGGGATAATCCGTTGGTGTTCACATCTGCGAACTACTCGACCTCCTTGTTAAACC
AATATGACAATGGCACGCTCTACATCCAACATCGTGCAGCAGGCGCAAACAAATACCGCTATTCAACAAATTTTGGTTCC
TCATTCTCTGACTGGAAAGACTACCACGGAGGAAACGATACTATTGAAGAACTGCCCTGGAGTGGAACGGACAAGCAAAA
GTGGCAAGGGAAGCACGTGCGAGTCGAATACTGGAATAAGTTAACCGGCAGCAGTGACTACGCTCAGGAAGGCGACTCTG
GATATGACCATCCACGACGCTTTCCCCATCTTTTCTTCAACGGGCCATTTAACCAATATGGATATGATGCGGGCTTAGAC
AACGTTGTGAGGCAAGACAGTGATGGTCTTTGGAAGTTCAGATTCATGGCTGAGTTTCCAGCACAAGGACAGTTCAATGT
TTGGGGAATGAATCCAGATGGTCAACCAGACCAGAGCTACGTGTTCGGTGATATAGATGATGACGGAGTTTTGGACCGTA
TGCCTCCTTCTTCGCTTAGTTCCACGATAATAAACATCACGGATATCCCTCCATCTCCATACTTGGCGTGGAATCTTGGT
GTTGACGACGGAACTCTGCGTGTTCATCTTCTGCCAACGGGTTCAAGGACCATCCAGATGGTTGTGTACTTCCTCCTCTG
GTTTGTTCCCCTTGTCACAGCCATCGCTTGTGTCTATGCCTTCGTGAAATCCTTCTACCAAGTCAAGTTCAACCAAGTGG
GGGTCAGCGAAAAGAAATCAATTCTTCCATTGGCATTCCGCAGGAAAATGAACCCCGATGGAAGCGGGGGATCAATCAAT
CCTTTCATGCGCCTTGCCAATAAGTCCGGATTCTTGCAAAGCACACCTGCTTTTGGAGCAGTAGCTTCACGAAGACGGAC
GACCTTGATTGCCACCATGGAATATGATATTGAGGACTGGGCCATCAAGATTAAAATCGGTGGTCTGGGTGTTATGGCTC
AGCTTATGGGCAAACACCTTGGGCAGCAGGATCTAATTTGGGTTGTTCCATGCGTGGGAGGAGTTGACTACCCGGTAGAT
CAGCCAGCTGAGCCTATGTTTGTGACAGTGCTCGGAAATTCCTACGAAGTCCAGGTGCAATATCACGTCCTGAATAACAT
```

Fig. 23

```
TAAATATGTCCTTTTAGATGCTCCTGTTTTTCGTCAACAGACCAAATCTGAGCCTTATCCCGCCCGAATGGACGATTTGG
ACAGCGCAATCTACTATTCCGCTTGGAACCAGTGCATTGCACAAGCAATCAGACGTTTCCCAATTGATCTTTATCATATC
AACGACTACCATGGATCCATTGCCCCTCTTTATCTTCTGCCTCAAACCATCCCTGTTTGTCTGTCGCTCCACAATGCCGA
GTTCCAAGGACTGTGGCCCATGCGTACCCAGAAGGAGAGGGATGAAGTCTGTTCTGTTTTCAACCTTGATCTTGACACTG
CAAAGCGTTACGTCCAGTTTGGCGAAGTTTTTAACATGCTTCATGCTGGAGCAAGCTACCTACGCGTGCATCAACAAGGG
TTTGGTGCAGTGGGCGTTTCTCGGAAGTATGGTAAACGTACTTATGCCCGGTACCCTATCTTTTGGGGTCTGAAGAAAGT
TGGAAATCTACCGAACCCGGACCCTTCAGACACTGGCGAATGGAACAAGGAGTTACCAAAGGACAGCGAGATTCAGGTTG
ACGCGAACTACGAGGCCAGCAGAGGGGAGCTTAAGCGGCAAGCGCAGGAATGGGCGGGCTTGGATCAGAACCCTGATGCT
GACCTGTTGGTGTTTGTTGGAAGATGGTCTATGCAGAAGGGCGTGGACCTTATTGCTGATGTGATGCCTGCCGTTCTGGA
AGCACGTCCCAATGTTCAACTCATCTGTGTTGGTCCAGTCATTGATCTTTATGGTAAATTTGCTGCGCTTAAGCTCGACC
ATATGATGAGGTTGTATCCTGGGCGTGTCTTCTCAAAGCCTGAGTTTACTGCACTTCCAGCATATATCTTCTCTGGCGCT
GAATTCGCCCTGATTCCATCTCGTGATGAACCTTTTGGTCTTGTTGCTGTTGAATTTGGTCGAAAGGGCGCTCTTGGTAT
TGGCGCTCGTGTCGGTGGTCTCGGCCAGATGCCTGGTTGGTGGTATAATATTGAGTCTACAACAACTTCCCATCTCTTGC
ATCAATTCAAGCTTGCGATTGGAAGCGCGCTTAACTCGAAGCCCCAAGTTCGTGCAAAGATGCGTGCACGCTCTGCAAAG
CAACGCTTTCCTGTTGCTCAGTGGGTGGAAGATTTAGAAATTCTGCAGACCACTGCTATGCGGGATTCACAGCAAGGGACA
GGCAAAATCGAACGGTGGGCCTCTCTCGCCTTCTGGTTACAATACACCAAGTGAAGTAATAACACCAAGTGGAATGATGA
CACCTACGATTGCATCGACTGGTACCACGACCCCAACAGGGATGCAGACACCTCCAATCGCACACTCACGGGAAGGCAGT
TACACGAATCTCAGCGTCAACCGCGACAGTGCATACGGGCCCCAACAGCGCAACACAATTGTGTACAGCCGTGACCCAAG
TCCTGGAGGTAACGACGAACCTAGGTTAAGCCTTGGTCGGCAACTGTCACTTGGATTCCGGGCTGGACCAGGACATATTA
ATCTCCGTGGTCGTCGGCTTAAAAGAAGAAGCCAGATGGGCAACGAGGAGAGTGGTACAGCGACCGAAGAAAGCAGTGAT
GACGATTATTTCCGCGGAGAGGAAGAAGTTACGATTACGAGGGAGCAAGCAGATGAAGGACGGCATCAACGCAATCCTCT
GAGGTCGCTTGCATCTCCTACCAACTCTTACTTTGAAGAAGGCATAACATCCGGAAGGCCACCTTGGGCTCAACCTGGGA
ATCGACTCAGTAGTGCATCCGTTCTTTCTGTTGATTCTGTCGTCGGCGAAAAGAAAGACTATAAGCTGCAGAAAGTTGAT
CCATTCTTCACAGACGGTACTGGCGAATACTATCGAGTGTTTGATCAGAGACTCGAGAAGCTCAACGGATCTAACTCTGA
ATCTCAGCTTTGTATAGAGGAGTATCTGATGAAGAGCGAAAAGAAGTGGTTTGACAAGTTTAGAGACGCAAGATTGGGGC
GCAACCAATCTCCCGCTTCTTCGATTTTCCAAACCAAGGGCGAAAACAACACACCTATGAGCTCAATCTCCCACGAGGAT
CTGGGTTCAAACGAAAGTGGCAGCGATCCACGCGCAGAAAAGGACGAGTTCCTTCTGGGACGAGACTATGTTCCCCCCTC
GGGCTTAAGGAAATGGATGCAAATTCGAATCTTTGGCTGGCCTGTGTATTCGTTTTTCCTAGGTCTCGGTCAGATCATTG
CGGCCAACTCGTACCAGATTACCTTGCTTGCCGGTGAAAACGGCCAGACAGCTGGGAAGCTCTATGGTATTGCGACAGTA
TACCTTGTCACTTCAATCATCTGGTGGTTTTTCTTCCGCTTCTTCAAATCGGTGTTTGTCCTTTCCATACCTTGGTTCTT
ATACGGCGCATCGTTTGTCATCATTGGATTAGCACACTTTGAGTCAAATGGCTTCGCTCGTGGATGGATCCAGAATGTGG
GAAGCGGTGTTTATGCTGCTGCTTCTTCAAGTGGATCACTGTTCTTCGCTCTCAATTTTGGCGATGAAAGCGGTGTTCAG
GTTAAAGACTGGGTTTTCCGCGCATGCCTCATCCAAGGAACTCAGCAAGCATATGTTATTGGGCTGTGGTACTGGGGAAC
GACAATCTCTAGCGCTGTCGCCAATGGAGTTACCAACGTCAACGGTGGCATTGTCAACTCCTGGAAAATGACGTACGTTT
CACCGTTATCATTATGATTACAATTGCTAACAGGCTCTTGTAGCGCAATCTGCATGCCAATCGCTGCATTCCTCTGGGCC
ATTGGTCTGATAATCTTCTTCGGCCTGCCCAATTACTACCGCCAGTCACCTGGAAAAGTTCCATCATTCTATAAGTCTGT
CTTCCGGCGCAAGATCGTTTTGTGGAACTTCGTGGTAGTCATTTTGCAAAACTTCTTCCTCAGCGCACCTTATGGACGGA
ACTGGGCCTGTAAGTACATCAGACCTATACTCTCCAAGAAGCCACTAACTTATCGTGCCCCATACAGTCCTTTGGAGCTC
AAACCATGCCGAAGCCTGGCAAGTCGGCATCCTCGTCGTCGTCTTCTTCGGTGTCATCTGGGTAGCAGTGTTAACCCTGT
TTGGATATCTCTCCAAGCGCCATAGCTGGATTCTACCTGTATTCGCATGTGGTTTGGGAGCTCCACGTTGGGCCCAGATA
TGGTGGGGTGTCTCCGGAATGGGTCTCTTCCTTCCCTGGGCTGGCAGTTCTGTTAGCGGAGCACTCGCATCACGAAGTCT
ATGGCTCTGGCTCGGTATCCTTGATGCCTTACAGGGTCTCGGCTTCGGCATGATTCTTCTCCAGACCCTCACACGAGTAC
ATATAGCCTTCACCCTGCTTGCATCTCAAGTGCTGGGTTCCATCGCGACAATCGTCGCCAGAGCATGTGCTCCAAACAAC
ATCGGCCCTGGACCAATCTCCCCAGATGTGACTGCCGGTGGCAGTTCCGTCGCAAACGCTTGGTTCTGGATCGCCTTATT
CTTCCAGCTCTTGATCTGGTAAGTCATCGATCCCCCTACAATCCATTTCACAGGAAGCAAAATACTAACAAAGCCCCAGC
GCTGGATTCCTTCTGTTCTTCCGGAAAGAACAACTCACCAAGCCCTAA
```

Fig. 24
PUTATIVE AMINO ACID SEQUENCE OF Aspergillus sojae AgsB

```
MKWAFSSTVLALFATTATAWPYEESLSAYNLNENKSATNPAQYWGEWPDHKGKYFPSPDNWRFPVYTLFMDRFVNGDPTN
DNINGTLFEHDISSTQMRHGGDVAGLVDTLDYLQGMGIKAIYLAGTILMNQPWGSDGYSALDTTLLDQHFGDIATWRNAI
DEIHKRGMYVIFDNTIATMGDLIGFEGHLNDTTPFSVKEHKALWKSDRRYVDFDLGNDYNQTCDYPRFWYEDGYPVQQSM
TEGLVGCYDSDFDQYGDIEAFGVFPDWQRQLAKFASVQDRLREWHPSVRERLIRHSCMIIYQLDIDGFRYDKATQSTVDA
LGDMSMAYRECARAVGKENFFISGEITGGNTFGSIYLGRGRQPNQYPKTAEEAMKMTNESESQYFLREAGHEAIDGAAFH
YSTYRALTRFLGMDGNLAAGYDVPVDWVDAWNLMLQSNDFINPNTGKFDPRHMFGATNQDVFRWPTVEKGVERQLLGLYI
TTLLLPGIPLLLWGEEQAFYILDATASNYIYGRQAMSPATAWRDHGCFSLDSSQYYQWPIQAGREGCHDPTAAYDHRDPA
HPVRNIIKHMYQLREDFPVLNDGYSVQKLSNLTEEVFYPGSNGTATETGLWSVLRDVNAEVQDLGSDAKNQPVWLVYHNT
NRTIDFKFDCKDNETALISPFPTGTKVRNLFYPYDEHTLIDGPVKLGLNGSTELNGCLANMTLDAYEFRAYVPSTRFTKP
RPMITQFTPGHDVPVRSTVAPDMDESVKIELYFSEEMDCDSVTKAISITSSTESRKVPTLDEKTVDCKGIPASNTSWTGQ
LPSVFMWAANLTGVYNGIHRVTVKNASSTNGNATTNAVDHFLFRIGQIDNPMVFTSANYSTSLLHEESNGTLFVQHHAAG
ADKWRYSTNWGTTFSEWKDYTGGNDTITELEWSGTKKQRWQGHHVRVEYWSKWTGSSDYVQEGDVGVHSNLPRRFPHIFF
NGPYNQYGYDGGLDNVVRQDSKDGLWKYHFTAEWPAQAQLNIWGMNPDGKPDQSWVLGDADNDSVLDRMPPSSLSATLIN
ITEHPPKPYLAWNIYINDATMKFQLFPVGHQNTQIAMFVLFWIIPVITGAACVYIFMKSFYKVKFNQIGVSEKATLIPLA
LRRKFKRNRGGDEEKMNPLMRLANKSGFLQTNTAIGGAASGKRRMVLIATMEYDIEDWQIKIKIGGLGVMAQLMGKTLGH
QDLIWVVPCVGGVEYPVDTPAEPMNVTILGNSYEVQVQYHVLNNITYVLLDAPVFRQQSKSEPYPARMDDLNSAIYYSAW
NQCIAEACKRFPIDLYHINDYHGSLAPLYLLPDTVPACLSLHNAEFQGLWPMRTQKEKEEVCSVFNLDIDIVRRYVQFGE
VFNLLHSGASYLRVHQQGFGAVGVSKKYGKRSYARYPIFWGLRKVGNLPNPDPSDVGEWSKEKAIGNADEVHVDPDYEAG
RADLKRQAQEWAGLEVNPDADLMVFVGRWSMQKGVDLIADVMPAVLEARPNVQVICVGPVIDLYGKFAALKLDHMMKVYP
GRVFSRPEFTALPPYIFSGAEFALIPSRDEPFGLVAVEFGRKGALGIGARVGGLGQMPGWWYNVESTATSHLLYQFKLAI
DAALNSKQETRAMMRARSAKQRFPVAQWVEDLEILQTTAIQVHNKELVKHNGRPFTPTGTITPSGLMTQPASPPMTPGMQ
TPLAHSRESSYSNLNRLSEYVTQPKTSYSRDPSPSGTEKPKSGLQRQLSLGVRSGPGHQSRRGRARQRDSIPEHEDTQEA
HGGAITDVEEESSDDDIVNHYADDEYTLTPAQVEEGRRLQAAQQQAGGRRYSQDSLHPRNVQPPSSPGTPPAASQSLLPP
PRLLDPGSRLSSASVLSLDSVVGGKKDFKLQKVDPFFTDSTGEYYKVFDKKLDELNGSNSESQLCIEEYLIKSEKEWFDK
FRDARLGRTKSPTPSVYRDKHGASPIGSFYDDNGSRISGSDGPHSNDSEDDEFLLGKDYVPPTGLKKWMQIRIGDWPIYS
LFLALGQIIAANSYQITLLTGEVGQTAEKLYGIATTYLITSILWWLVFRYFKSVVCLSAPWFLYGIAFIFIGSAHFESNS
FSRGWIQNVGSGFYAAASSSGSFFFALNFGDEGGAPVETWIFRACLIQGIQSAYVIALWYWGSTLSQAQSEGLLTPTNNI
SNSWKMSAICYPIAAALFGIGLLLTFGLPNYYRQTPGKVASFYKSVLRRKIVLWNFVAVILQNFFLSAPYGRNWQFLWTS
HHVHHWQIVILCVVFYGFVWAGFLFVVSRYFKSHSWFLPVFACGLGAPRWAQIWWGVSGIGYYLPWVTGGYTGGALVSRS
VWLWLGVLDSIQGLGFGIILLQTLTRMHMVFCLVCSQVLGSIATICARAFAPNNVGPGPVSPDPTFGGSAVANAWFWVAL
FCQLLVCAGYILFFRKEQLSKP
```

Fig. 25
BASE SEQUENCE (PUTATIVE) OF NUCLEIC ACID MOLECULE OF Aspergillus sojae agsB

```
ATGAAGTGGGCTTTCTCCAGTACGGTGCTGGCGCTTTTCGCAACAACAGCAAGGGCCTGGCCTTACGAAGAATCACTATC
CGCATACAACCTTAACGAAAACAAATCCGCGACCAACCCGGCTCAATATTGGGGAGAATGGCCGGACCACAAGGGGAAAT
ACTTCCCTTCTCCCGACAATTGGCGATTTCCCGTCTATACCCTGTTCATGGACCGCTTTGTCAACGGAGACCCTACGAAT
GACAACATTAATGGGACCCTCTTCGAGCACGATATCTCCTCGACACAGATGCGCCATGGTGGAGATGTGGCTGGTCTAGT
GGATACTTTGGATTATCTTCAGGGAATGGGTATCAAGGTGCGTCATTCGTTCATTTCAATTACGTGGGATGGCATACTGA
GAATTCGTAGGCCATCTATCTCGCAGGAACTATCTTGATGAACCAGCCATGGGGCTCTGATGGTTATTCCGCTCTCGATA
CGACGCTGCTCGACCAACACTTCGGTGACATTGCGACATGGCGTAATGCTATCGACGAGATTCATAAGCGCGGGATGTAT
GTCATCTTTGATAACACGATTGCTACGTAAGTCTTGCCGCATCCACGATAGTACATATGAGGTGATTGTTAACGCTTGTA
TTCAGGATGGGTGATCTCATCGGCTTCGAGGGCCACTTGAATGATACCACCCCGTTTTCGGTTAAGGAGCATAAAGCGCT
TTGGAAGAGCGATCGTCGCTATGTGGATTTCGATCTCGGAAACGACTATAACCAGACATGCGACTACCCCCGGTTCTGGT
ACGAGGACGGTTATCCAGTTCAACAGTCCATGACCGAGGGCCTTGTTGGTTGTTATGACAGTGACTTTGATCAATATGGT
GATATTGAGGCCTTCGGCGTGTTCCCTGATTGGCAACGTCAGCTAGCAAAATTTGCGTCCGTCCAAGATCGTCTACGAGA
ATGGCACCCCTCGGTGCGGGAACGGCTGATTCGCCATTCCTGTATGATTATCTACCAGTTGGATATCGACGGTTTCCGTT
ATGATAAGGCGACTCAGTCGACCGTGGATGCGCTGGGAGATATGTCGATGGCTTATCGCGAATGCGCCCGTGCCGTTGGC
AAGGAGAATTTGTTCATCTCCGGTGAAATTACTGGTGGTAACACTTTTGGTTCTATCTATTTGGGCCGAGGCAGACAACC
TAACCAGTATCCTAAGACGGCGGAGGAGGCCATGAAAATGACCAACGAGTCCGAGTCGGCAATACTTCCTGCGTGAAGCTG
GACATGAGGCGATCGACGGCGCGGCCTTCCACTATTCGACATATCGTGCTCTGACTCGGTTCTTGGGTATGGATGGTAAC
TTGGCCGCCGGTTACGATGTTCCTGTGGATTGGGTCGATGCGTGGAATTTGATGTTGCAGTCGAACGACTTCATCAACCC
TAACACGGGCAAGTTCGATCCCGGCCATATGTTTGGCGCGGACCAACGAGGATGTTTTCCGCTGGCCAACAGTCGAAAAGG
GTGTGGAAAGGCAGTTGCTTGGGCTGTATATCACTACCTTACTTCTTCCGGGGCATTCCCCTCCTCCTTTGGGGCGAGGAA
CAGGCATTCTATATCTTAGATGCGACAGCATCTAACTATATCTATGGCCGTCAAGCAATGTCCCCCGCGACTGCGTGGAG
AGACCACGGTTGCTTTTCCTTGGATTCCTCACAGTATTATCAGTGGCCGATTCAGGCCGGTCGTGAGGGTTGCCATGATC
GAACTGCTGCGTACGATCATCGTGATCCGGCCCACCCGGTGCGCAACATTATTAAGCACATGTACCAGCTGCGCGAAGAC
TTCCCTGTTCTGAACGATGGCTACTCCGTTCAGAAACTCTCGAACTTGACCGAGGAGGTCTTCTATCCGGGCTCCAACGG
TACCGCTACAGAAACGGGTTTGTGGTCTGTCCTACGTGATGTCAATGCGGAGGTGCAGGACCTGGGCTCCGACGCGAAGA
ATCAACCGGTTTGGCTCGTCTACCACAACACCAACCGTACAATTGACTTCAAGTTCGACTGCAAGGACAACGAGACTGCA
CTAATCTCCCCCTTCCCCACCGGCACCAAAGTTCGAAATCTGTTCTATCCCTATGACGAGCACACCTTGATTGATGGCCC
CGTCAAGCTTGGACTGAACGGATCTACCGAGCTCAACGGCTGCCTGGCCAACATGACATTGGACGCCTATGAGTTCCGCG
CCTACGTCCCCAGTACACGTTTCACTAAGCCCCGGCCGATGATCACCCAGTTTACTCCCGGCCATGACGTCCCTGTTCGC
TCCACGGTGGCTCCCGATATGGATGAAAGCGTGAAGATTGAGCTCTATTTCTCCGAAGAGATGGACTGTGATTCCGTGAC
TAAAGCAATCTCCATTACCTCTTCTACGGAATCTAGAAAAGTCCCGACACTGGATGAGAAGACTGTAGATTGCAAGGGAA
TTCCGGCAAGCAACACATCGTGGACTGGGCAGCTCCCTAGCGTCTTCATGTGGGCTGCCAACCTGACGGGAGTGTACAAC
GGCATTCACCGGGTTACAGTTAAGAACGCTAGCAGTACTAATGGAAACGCGACGACAAACGCCGTCGACCACTTCCTCTT
CCGGCATTGGACAAATCGATAATCCCATGGTCTTTACATCGGGCCAACTATTCGACTAGTTTGCTCCACGAGGAATCGAATG
GTACCCTGTTCGTCCAGCATCACGCGGCTGGTGCTGATAAGTGGCGTTATTCTACCAATTGGGGCACCACTTTCTCCGAG
TGGAAGGATTACACAGGTGGCAATGACACTATCACGGAGTTAGAATGGTCTGGAACCAAGAAACAGAGATGGCAGGGACA
CCATGTGCGGGTCGAGTATTGGAGCAAATGGACCGGTAGCAGCGATTACGTTCAGGAGGGCGATGTTGGAGTGCATTCGA
ATCTGCCTCGCCGCTTCCCCCATATCTTCTTCAACGGCCCTTACAATCAGTACGGCTATGACGGTGGTCTTGATAACGTG
GTGAGGCAGGACTCCAAAGACGGTCTCTGGAAATATCACTTCACGGGCGGAATGGCCTGCTCAAGCTCAGCTGAACATTTG
GGGCATGAATCCGGATGGAAAGCCTGATCAAAGCTGGGTGCTGGGTGATGCCGATAATGATTCCGTTCTGGATCGAATGC
CACCCTCCTCTCTGTCTGCAACCTTGATCAACATCACCGAGCATCCGCCTAAGCCTTATCTGGCTTGGAATATCTACATC
AACGATGCGACCATGAAGTTCCAGCTCTTCCCTGTGGGGCACCAGAACACGCAGATCGCCATGTTCGTGCTCTTCTGGAT
CATCCCTGTCATCACCGGTGCAGCATGCGTCTACATTTTCATGAAGTCTTTCTATAAGGTCAAGTTCAACCAGATCGGTG
TGAGTGAAAAGGCCACATTGATCCCCTTGGCTTTGCGGAGAAAGTTCAAGAGAAATCGTGGTGGTGATGAGGAAAAGATG
AATCCCTTAATGCGTCTGGCCAACAAGTCCGGTTTCCTGCAGACAACACCGCTATTGGCGGCGCTGCTTCTGGCAAGAG
ACGCATGGTTCTCATCGGCGACCATGGAGTATGATATCGAGGATTGGCAGATTAAGATCAAGATTGGTGGTCTTGGTGTCA
TGGCCCAGCTTATGGGTAAAACTCTCGGACATCAGGACCTGATCTGGGTTGTTCCCTGTGTCGGCGGAGTCGAATACCCA
GTGGATACACCCGCTGAGCCCATGAATGTCACGATTCTTGGCAACTCCTATGAAGTTCAGGTCCAGTACCATGTCTTGAA
```

Fig. 26

```
CAATATAACCTACGTTTTGCTAGACGCCCCTGTGTTCCGTCAGCAATCGAAGTCCGAACCCTATCCAGCCCGTATGGATG
ACCTCAACAGTGCTATCTACTACTCCGCCTGGAATCAGTGTATTGCTGAGGCCTGCAAGCGGTTCCCGATTGACCTGTAC
CATATCAACGATTATCACGGTTCTCTAGCTCCGCTCTACCTTCTTCCCGATACTGTACCGGCTTGTCTCTCCCTTCACAA
TGCTGAATTCCAGGGTCTCTGGCCAATGCGTACACAGAAAGAAAAGGAAGAGGTGTGCTCCGTCTTTAACCTGGATATTG
ATATTGTCAGACGTTATGTGCAGTTCGGTGAGGTTTTCAACTTGCTGCACTCGGGTGCTAGTTATCTTCGTGTTCACCAG
CAGGGTTTCGGTGCCGTCGGTGTGTCCAAGAAGTACGGAAAGCGTTCCTACGCCCGTTATCCCATCTTCTGGGGGTTGAG
AAAGGTTGGCAACCTGCCTAACCCTGATCCTTCAGATGTGGGAGAATGGAGTAAGGAAAAGGCTATTGGCAACGCTGACG
AGGTTCATGTGGATCCCGACTATGAAGCCGGCAGAGCCGACCTCAAACGCCAGGCTCAGGAATGGGCTGGTCTTGAAGTC
AACCCCGACGCTGATCTTATGGTGTTCGTTGGTCGTTGGTCCATGCAGAAAGGTGTTGATTTAATCGCCGATGTGATGCC
CGCTGTTCTTGAAGCTCGTCCTAACGTCCAAGTGATTTGTGTTGGACCTGTTATCGATCTTTATGGTAAATTCGCCGCCT
TGAAGTTAGACCACATGATGAAGGTTTACCCTGGACGTGTGTTTTCGAGACCTGAATTCACCGCTCTTCCGCCTTATATC
TTCTCTGGTGCTGAATTCGCGCTTATTCCTTCTCGTGACGAGCCCTTTGGTCTAGTCGCAGTCGAGTTCGGCCGTAAAGG
AGCCTTGGGTATTGGTGCCCGTCGTTGGTGGTCTCGGTCAGATGCCTGGTTGGTGGTATAACGTCGAATCTACTGCGACAT
CTCATCTTCTGTACCAGTTCAAACTTGCCATTGACGCCGCACTGAACTCGAAACAAGAGACCAGAGCCATGATGCGTGCC
CGTTCTGCTAAACAGCGATTCCCCGTCGCCCAATGGGTCGAGGACCTGGAGATCCTGCAAACCACCGCAATTCAAGTACA
CAACAAGGAACTGGTTAAGCACAACGGTCGGCCGTTCACTCCTACTGGAACAATTACTCCTAGTGGCCTTATGACTCAGC
CTGCGAGCCCGCCCATGACTCCGGGTATGCAAACTCCTCTTGCTCATTCCAGGGAAAGCAGCTACTCGAACCTCAACCGC
TTAAGTGAATACGTTACCCAGCCGAAGACCAGCTACAGCAGAGATCCCAGCCCTAGCGGCACGGAGAAGCCGAAATCAGG
ACTTCAGCGACAGCTTTCACTTGGTGTTCGCTCTGGTCCTGGTCATCAGAGCCGTCGTGGTCGCGCTCGCCAGCGTGACA
GTATCCCAGAACACGAAGACACTCAGGAAGCCCACGGTGGCGCCATTACTGATGTTGAGGAAGAAAGCAGTGACGACGAT
ATTGTCAACCATTATGCGGACGACGAGTATACTCTTACGCCGGCACAAGTCGAAGAGGGCCGCAGGTTACAGGCCGCCCA
GCAACAGGCTGGTGTGCGCATGCCGTTGAGTCCAGGTGGTAGACGCTACAGCCAAGACTCATTGCATCCCAGAAATGTCC
AGCCTCCTTCAAGTCCCGGAACACCCCCAGCCGCTTCCCAGAGCCTCCTTCCTCCCCCTAGGCTCCTCGATCCCGGCAGC
CGTCTCAGTAGCGCATCCGTTCTCTCACTTGACTCCGTTGTCGGTGGCAAGAAGGACTTCAAGCTGCAGAAGGTTGATCC
GTTCTTCACCGATAGCACCGGCGAGTATTACAAGGTCTTTGATAAGAAACTTGATGAACTCAATGGATCGAACTCGGAGT
CGCAACTGTGTATCGAAGAATACTTGATCAAGAGTGAAAAGGAATGGTTCGATAAGTTCCGTGACGCCAGACTTGGTCGC
ACCAAATCGCCAACTCCCTCAGTCTACCGTGATAAACACGGCGCCTCACCTATCGGCTCGTTTTACGATGATAACGGCTC
CCGCATTAGTGGTAGCGATGGGCCTCACTCCAATGACAGTGAAGACGACGAGTTCCTTCTCGGAAAGGACTATGTCCCTC
CCACTGGTCTCAAGAAGTGGATGCAGATCCGCATCGGTGACTGGCCTATCTACTCCTTGTTCCTCGCTCTAGGCCAAATC
ATTGCTGCCAACTCGTACCAGATCACATTGCTCACGGGTGAAGTCGGTCAAACTGCCGAGAAACTGTACGGCATTGCAAC
CACGTATCTGATCACGTCTATTCTGTGGTGGCTTGTGTTCCGCTACTTCAAATCCGTCGTCTGTCTGTCTGCGCCATGGT
TCTTGTACGGTATTGCCTTCATTTTCATTGGATCCGCCCATTTTGAGAGCAACTCTTTCAGTCGGGGATGGATTCAAAAT
GTCGGTAGTGGGTTCTACGCTGCGGCCTCGTCTAGTGGTTCTTTCTTCGCATTGAACTTCGGTGATGAAGGTGGTGC
ACCTGTGGAAACATGGATTTTCCGTGCATGCTTGATTCAGGGTATTCAGTCCGCCTATGTTATTGCTCTCTGGTACTGGG
GTTCAACCCTGTCACAGGCACAAAGTGAGGGTCTCTTGACTCCTACAAACAATATTTCCAATTCCTGGAAAGATGAGGTTT
GTTCTATTAACATTCAATCGTTAATTCTACTAGCTAACTGAGCCTTTCACAGTGCAATCTGTTACCCCATTGCCGCCGCC
CTTTTTGGAATCGGCTTGCTCTTGACATTCGGTCTGCCCAATTATTATCGCCAGACTCCTGGAAAGGTCGCTTCCTTCTA
CAAGTCCGTGTTGCGTCGTAAGATCGTCCTCTGGAACTTTGTGCGCGGTCATCCTTCAGAACTTCTTCCTCAGCGCCCCT
ACGGCCGCAACTGGCAGTGTAAGTTGACCTCTGTATAACGGCTTCTCTCACACCAGACCAAACTAACTGTGTCTCTTTAC
AGTCCTCTGGACATCCCACCACGTACATCACTGGCAAATCGTCATCCTCTGTGTTGTTTTCTACGGCTTCGTATGGGCAG
GTTTCCTATTCGTTGTCAGTCGCTACTTCAAATCACACAGTTGGTTCCTCCCCGTGTTCGCCTGTGGCCTCGGAGCGCCC
CGCTGGGCACAAATCTGGTGGGGTGTGTCTGGCATTGGCTACTACCTTCCTTGGGTGACAGGAGGATATACCGGCGGCGC
GCTCGTCTCCCGGAGTGTCTGGCTCTGGCTCGGCGTGCTGGACTCGATCCAGGGTCTCGGCTTCGGTATCATCCTCTTGC
AAACCCTCACTCGCATGCACATGGTTTTCTGTCTTGTTTGTTCTCAAGTCCTTGGTTCGATCGCTACTATCTGCGCGAGA
GCCTTCGCCCCTAATAATGTGGGCCCAGGGCCGGTTTCGCCTGATCCTACCTTCGGTGGTAGCGCTGTTGCGAATGCCTG
GTTCTGGGTTGCTCTGTTTTGTCAGTTGTTGGTCTGGTAAGTTATTCACATTCCTTAAACTTCGTTATTATAGGATAATT
GCTAACGTGTCGTGTTTTCAGTGCCGGTTACATCCTCTTCTTCCGGAAAGAACAGCTGTCAAAGCCGTAA
```

Fig. 27
PUTATIVE AMINO ACID SEQUENCE OF Aspergillus sojae AgsC

```
MFLTVMQRSAILILSLLSATALSWPYTESLVDYNLNENKTAEAPIDYWGEWPDHEYHPSPDNWRFPIYTIFLDRIANGDP
KNDDINGTAFEHVVGSNQMRHGGDLVGLIDTLDYIRGMGFKGIYFAGTYLMNLPWAYDGYSPVDTTLLDMHHGTLEDWRR
TITEIHKRDMYVIMDNTLATMSNLIGFKGHLNDSADFRADEYEVQWISDRQYADFKFGNEYNETCNFPKFWNETGYPLTS
GGVEELKGCYNSDFDQFGELEAFGNFPDWKRQLTKFASVQDRLREWHKPIRDVITKHSCIQIASLDIDGFRFDKAVQATL
EPLSEITAVYRECAKKYGKHNFFLPGEITSGNTFGSLYLGRGRQPDQQPESADAGAKLKNSSDGYFLRDDGYQALDSAAF
HYTIYRSMTRFLGMDGNLVAGFDLPTDFIEAWNGMLVSNDFLNAYTGEVDPRHMFGVSNQDNFRWPAIRNGTEKYLLGLY
IVTLELPGIPLILWGEEQAMYVFESTASNYLFGRQPMTYQTAWWTHGCMTLNTSKFYDFPNEKGLHGCEDITVTYDQRNP
AHPLRNIMKRMFEIREQYPVANDGFYLQTLSQLTKDVYLPGSADTPTVTGLWSVLRSYFPGVQKEASKNSQNLWLKDTAL
LSPFKSGTKLKNLFYPYDELTLEDGPGEVAVHNSTESYGCIRSMKLLPWEYRAYIEAENFVEPGPTVTEFVPGHDARLLS
TDDSGQTVDIQLGYSKEMDCDKIADAISLNSTTVKGVTASLDTSSVSCNKISARTSSDNFVGEVPTVWTWSAKLKNVHHG
IHQLTVKNVSTTSGVHTDAVDQFLFRVGSQNNPLLSPLSNYSTSLVQKSDNGSFYIQHDAAGADKFRYSTDFGLNWSNWT
TYTGDNTLVNFPEWTGTDAQKWKGTHIRVQYFSRLTGSSDYIQEGDHGWEKGVARRFPNLFWNGPFNQYGYDAGLDNKMR
YDTKEHRWKYDFVYEWPAIGQMSVWGMLKDGRPDVTEVYGDVDNSSVVQKLPPSYLSSNVINITKLPPFPHLGWTITLND
ANLRYEMLPVGSGWAQLVLYILLWVLPILMGFAGIFIFIRTFYRVKLNTDGDVAKEDKLPLLFWRRVREKFSGDDESDKS
ISDKDIPTDIAIAGAPEQRRTVLIATMEYNIEDWKVKVKIGGLGVMAQLMSQHLKHQNLIWVVPCVGDIEYPQDTPSEPF
VVTILDKPYFINVQYHIVDNITYVLLDAPVFRQQTKAEPYPPRMDDLDSAIYYSAWNQCIAETIKRFPSIDLYHINDFHG
CLAPLYLLPTRTIPVCLSLHNAEFQGLWPLRNPHEKKEVCSVFNLPIETATKYSQFGNVFNLLHTGASYVRFYQRGFGAV
GVSKKYGKRSWARYPIFWSLEKIGSLPNPDPSDTGDMTNNPDAEVPIQSYEERINDKLQAQKWAGLNEDRDADLLVFVGR
WSKQKGVDLIADVMPAILSARPHVQLICVGPIVDLYGRLAATKLERIMEMFPGRVFSKPEFTVLPPYVFSGADFALIPSR
DEPFGLVAVEFGRKGALGIGSRIGGLGQMPGWWYTVESDATRHLLHQLKTAIKQALDSSQEAREEMRANSVRQHFPVLEW
IQKLEALQRTAIQIHHTKNKNTVTGPMPESQNYWETQSVRMSTLGLPGPTQSMTEGLDTPPDRLLMPGQSRFTELQLEGA
DGNRNSSLGRKLSLGRRSGPGQDRKRLGKSPPRESQILGEDLEGENTDAEEEGTATPHVNYISPEEAMAAVNNTLGTQDI
GTAHTNNSTHSLAGPQGSTYMSAPGSPNNMSRASSPMPGTPALPQYPFQLALGSGGNTPFAHSRNVSMLSLPSVVADHNQ
PVFELQKVDPTFTDSTRHFTRRFEEILNNLNKKNSMTDCCIETYLMKSERKFYSMYNDAQLKKQPDDRAVSDSNSDTQDN
RASYATVTGGSDSNDPDEIDLWLSRLGYKRPIAIQRFMRRRLGKWPVYALFLGLGQIIATNSAQMTLLVGQVGETATKLY
IIATIYCISSICWWLLFYRFPSVIVLTLPWFIYCMAFIIIGVSPFALTSLGRAWAQNVAAGVYSAASSSGSLFFALNFGD
QGAVPIKDWMFRASLIQGIQQLYTVALWYWSSKVTEAEVGGVSTAALSSWKLTAVVMPIAAVCFIVGVLLALGLPKYYRQ
SPGRILFFYTSLFRRRIVLWFFFMVIVQNWFLSAAFGRNWSFLWSSQHAKAWEVVILVIFFFVILWVIILIIFRALSKEH
SWILPVFGLSLGAPRWAQTWWGTSNIGYYLPWAGSLTSGALVSRCVWLWLGVLDEIQQVGLGMILLQTLTRVHVCFVLLA
AQALGSIATICARGFAPNKLGPAGISPNVGTSLDTVGNAWFWIALFFQLLASWGFLLFYRREQLNRP
```

Fig. 28
BASE SEQUENCE (PUTATIVE) OF NUCLEIC ACID MOLECULE OF Aspergillus sojae agsC

```
ATGTTCCTCACGGTGATGCAGCGCTCAGCGATTCTTATCCTGTCGTTACTGAGCGCTACCGCCTTAAGCTGGCCCTACAC
TGAGTCGCTCGTTGATTATAACTTGAATGAAAATAAAACCGCCGAAGCGCCGATTGATTATTGGGGAGAGTGGCCGGATC
ATGAATATCACCCGTCGCCCGATAACTGGCGCTTCCCGATCTATACCATCTTTTTGGACCGCATCGCTAACGGTGACCCG
AAGAATGATGATATTAATGGCACCGCCTTTGAGCATGTGGTGGGCTCGAATCAAATGCGCCACGGGGGCGATCTAGTTGG
TCTAATTGATACGCTGGATTATATTAGGGGCATGGGTTTCAAGGTGTGTTAAGCCGGTTGTGATCCGATCTTGGTGCTTA
CTATAGTAGGGTATTTACTTCGCTGGAACGTACTTGATGAACCTTCCCTGGGCCTACGATGGCTACTCACCGGTTGATAC
CACTTTGCTCGACATGCACCATGGCACACTCGAGGATTGGAGACGGACCATCACCGAGATCCACAAACGAGATATGTATG
TGATCATGGATAATACACTGGCAACGTAAGTACATACCCCAGATGTCTCAGATCAACACTGGTTGACAAGTATATGCAGA
ATGAGCAACCTTATTGGCTTCAAAGGACATCTAAACGATTCAGCCGATTTTCGAGCAGATGAATATGAAGTGCAGTGGAT
CTCAGATAGACAGTACGCGGACTTCAAATTCGGAAATGAGTACAATGAGACCTGCAACTTCCCGAAGTTTTGGAATGAGA
CCGGGTACCCGTTGACATCAGGTGGTGTCGAGGAGCTGAAAGGGTGTTACAATAGTGATTTCGATCAATTTGGAGAACTG
GAGGCGTTCGGTAACTTTCCAGACTGGAAGCGCCAGCTTACCAAGTTCGCCTCGGTGCAAGATCGTCTGCGCGAATGGCA
CAAGCCTATTCGTGATGTCATCACCAAGCATTCTTGCATTCAGATCGCCAGTCTAGATATCGATGGTTTTCGGTTCGATA
AAGCCGTCCAGGCAACCCTCGAGCCCCTAAGTGAGATAACCGCTGTCTATCGTGAATGTGCGAAGAAATATGGCAAGCAT
AACTTTTTCCTTCCCGGCGAGATCACATCAGGAAATACCTTTGGCAGTCTTTACCTTGGACGCGGTCGTCAGCCAGATCA
GCAGCCTGAATCAGCAGATGCTGGTGCTAAGTTGAAGAATAGTTCGGACGGATATTTTCTCAGAGATGATGGATACCAGG
CGTTGGACTCAGCCGCGTTTCACTACACGATCTACCGTTCGATGACTCGTTTCCTGGGAATGGATGGTAATCTAGTGGCT
GGCTTTGACTTGCCTACTGATTTTATCGAGGCCTGGAATGGGATGCTCGTCAGCAACGACTTCCTCAATGCATACACGGG
TGAAGTAGACCCGAGGCACATGTTTGGTGTCTCAAATCAGGAACAACTTTCGTTGGCCAGCAATCAGGAATGGCACCGAGA
AATACCTTCTGGGTCTTTATATCGTCACCCTGGAGCTCCCTGGGATTCCTCTGATCCTATGGGGCGAAGAGCAGGCGATG
TATGTTTTTGAATCTACTGCTTCTAACTACCTGTTCGGCCGGCAGCCAATGACGTATCAGACTGCATGGTGGACGCATGG
ATGCATGACTTTGAATACATCTAAATTCTACGATTTCCCTAATGAGAAGGGACTACACGGCTGCGAGGATATCACCGTTA
CGTATGATCAGCGGAATCGGGCACACCCTCTGCGCAATATCATGAAGCGCATGTTCGAAATTCGGGAGCAGTATCCGGTA
GCAAATGATGGGTTCTATCTTCAAACGCTTTCTCAGCTGACAAAGGATGTGTACCTCCCTGGTTCAGCGGGACACTCCGAC
TGTGACTGGTTTATGGTCGGTTCTGCGGAGCTACTTCCCAGGCGTCCAGAAGGAGGCAAGCAAGAACAGTCAGAATCTTT
GGCTTGTGTATCATAATGCTAACAAAACTGAAACCTACGGTGGTGACTGCAAAAAGAAAGATACCGCCTTGCTGTCGCCT
TTCAAGTCGGGAACGAAGCTAAAGAATCTCTTCTATCCTTACGATGAGCTCACTTTAGAAGATGGTCCGGGCGAAGTCGC
AGTCCACAACAGCACCGAGAGCTATGGATGCATCCGCAGTATGAAATTGCTTCCGTGGGAATACCGTGCCTACATAGAGG
CCGAGAACTTCGTTGAGGCCCGGCCCTACTGTTACTGAGTTCGTTCCTGGCCATGACGCCCGATTGTTGTCTACGGATGAC
AGTGGCCAAACTGTCGACATCCAGCTCGGATATTCAAAAGAGATGGACTGTGACAAGATCGCCGATGCCATCTCTTTGAA
CTCAACGACAGTGAAGGGAGTTACAGCTTCCCTTGACACATCTAGCGTGTCTTGCAACAAAATCTCGGCAAGGACAAGCA
GTGATAACTTTGTTGGGGAGGTTCCAACCGTTTGGACCTGGTCTGCCAAGCTGAAAAATGTCCACCACGGAATCCATCAG
CTGACGGTTAAGAACGTTTCCACGACGTCTGGAGTTCATACCGATGCGGTTGACCAGTTCTTGTTCCGTGTCGGAAGTCA
AAACAATCCCCTTTTATCCCCACTGTCCAATTATTCCACCAGTCTTGTGCAGAAATCCGACAACGGCAGCTTCTATATCC
AGCATGACGCCGCTGGGGCTGACAAATTCCGCTACTCGACTGATTTTGGCCTTAACTGGTCCAACTGGACAACGTATACC
GGTGACAACACCCTAGTCAACTTCCCAGAGTGGACCGGAACAGACGCTCAGAAGTGGAAGGGAACTCATATTCGCGTACA
GTACTTTTCAAGGCTCACCGGCAGTAGTGATTACATTCAGGAAGGTGATCACGGCTGGGAAAAAGGTGTTGCTCGAAGAT
TTCCTAACCTCTTTTGGAACGGTCCGTTCAATCAATATGGTTATGATGCGGGACTGGATAACAAGATGAGATACGATACC
AAGGAACATCGTTGGAAGTACGATTTTGTCTACGAGTGGCCGGCCATTGGACAAATGAGTGTCTGGGGAATGTTAAAGGA
TGGGCGGCCCGACGTTACAGAGGTGTATGGTGATGTTGACAACTCATCTGTAGTTCAGAAACTTCCTCCGTCTTACCTGT
CGTCCAACGTGATCAATATCACAAAGCTGCCTCCATTCCCGCACCTCGGCTGGACCATCACGCTCAATGACGCCAACTTG
AGATATGAGATGCTTCCGGTCGGATCTGGATGGGCCCAGCTCGTGCTATACATTCTTCTTTGGGTGCTTCCAATTCTCAT
GGGATTTGCTGGTATCTTCATCTTCATCAGGACATTCTACCGTGTTAAACTCAATACCGATGGCGATGTGGCTAAAGAAG
ATAAGCTGCCGCTCCTGTTTTGGCGGAGGGTCAGAGAAAAGTTCTCCGGCGACGACGAGTCGGATAAGTCGATATCTGAT
AAGGATATACCGACAGACATTGCTATCGCGGGAGCCCCTGAGCAACGACGTACTGTATTGATCGCCACCATGGAATACAA
CATCGAAGACTGGAAGGTCAAGGTCAAGATCGGCGGTCTAGGCGTCATGGCACAACTCATGTCCCAGCATCTGAAGCATC
AAAACCTGATCTGGGTTGTTCCTTGCGTTGGTGACATTGAATATCCTCAGGACACGCCATCCGAGCCTTTCGTGGTTACT
ATCCTGGACAAGCCATATTTTATCAATGTGCAATATCACATAGTTGATAACATCACCTATGTCCTGCTCGACGCTCCAGT
```

Fig. 29

```
TTTCCGCCAACAGACCAAAGCAGAGCCGTATCCTCCTCGCATGGATGATCTTGACAGTGCAATCTACTATTCGGCATGGA
ACCAATGTATCGCAGAGACGATCAAGCGATTCCCGTCGATCGATCTCTATCATATCAACGATTTCCATGGTTGTTTAGCA
CCACTGTATTTGCTTCCCACACGTACCATCCCGGTGTGCCTGTCCTTACATAATGCTGAATTCCAGGGTCTGTGGCCCCT
GAGAAACCCCCACGAAAAGAAGGAAGTCTGTTCGGTCTTCAACCTTCCCATCGAAACTGCAACCAAGTACAGTCAGTTTG
GAAACGTCTTCAACCTTCTTCACACCGGTGCAAGCTACGTGCGATTCTACCAACGCGGTTTCGGCGCAGTAGGTGTGTCC
AAAAAGTATGGAAAGCGCTCATGGGCTAGATACCCGATTTTCTGGAGCCTTGAAAAGATTGGCAGTCTTCCAAACCCAGA
TCCCTCCGATACAGGGGATATGACAAATAACCCAGACGCCGAGGTCCCAATCCAGTCCTACGAAGAACGAATCAACGATA
AGCTGCAGGCCCAGAAGTGGGCTGGTTTGAATGAAGATCGTGACGCTGACCTACTTGTGTTCGTCGGACGATGGTCGAAG
CAGAAGGGAGTGGATTTGATTGCAGATGTCATGCCAGCGATATTATCCGCCAGACCCCACGTGCAATTGATTTGCGTTGG
ACCTATCGTTGATCTCTATGGTAGACTAGCTGCTACAAAGCTAGAGCGCATCATGGAAATGTTCCCTGGTCGCGTTTTCT
CTAAGCCGGAGTTCACCGTTTTGCCTCCATACGTATTTTCTGGTGCCGACTTCGCCCTGATTCCCTCCAGAGACGAGCCA
TTTGGGTTAGTCGCTGTAGAATTCGGCCGTAAGGGTGCACTGGGAATCGGCTCTCGCATCGGAGGTCTAGGCCAGATGCC
AGGTTGGTGGTACACCGTGGAATCCGACGCAACCCGCCATCTTCTGCATCAGTTGAAGACCGCTATAAAACAAGCGTTGG
ACTCATCACAAGAAGCTCGTGAGGAGATGCGCGCCAATTCCGTCAGGCAACATTTCCCCGTTCTTGAATGGATTCAGAAA
CTCGAAGCCTTGCAGCGAACAGCAATCCAAATCCATCACACCAAGAACAAGAACACCGTGACAGGCCCGATGCCAGAATC
GCAGAATTATTGGGAGACTCAAAGCGTACGGATGTCTACGCTGGGCCTTCCAGGGCCTACCCAGTCGATGACAGAGGGTT
TAGATACACCGCCAGACAGGCTTTTGATGCCCGGCCAGTCTCGATTTACAGAACTGCAATTGGAGGGAGCTGATGGCAAC
AGGAACAGTAGCCTGGGTCGCAAACTCTCGCTCGGTCGGCGATCTGGACCTGGTCAGGACAGAAAACGTCTCGGCAAGAG
CCCACCGCGCGAGAGCCAGATTCTTGGCGAGGATCTGGAAGGTGAGAACACGGATGCCGAAGAAGAGGGCACCGCTACGC
CGCATGTGAACTATATTTCGCCTGAAGAAGCTATGGCTGCAGTTAACAACACTTTGGGAACTCAAGATATCGGAACGGCA
CACACGAACAACAGTACTCACTCGCTCGCAGGTCCTCAAGGATCTACTTACATGTCCGCGCCAGGCTCACCAAACAACAT
GTCAAGGGCTTCCTCTCCCATGCCAGGAACCCCGGCGCTGCCTCAATACCCATTCCAGTTAGCATTGGGTTCTGGCGGAA
ATACTCCTTTCGCTCACTCCCGCAATGTGTCCATGCTTTCCTTGCCTTCAGTCGTGGCGGACCATAACCAGCCCGTTTTT
GAGCTGCAAAAGGTTGATCCGACCTTTACAGACAGCACACGCCACTTCACGCGACGCTTCGAAGAGATCCTCAACAACTT
GAACAAGAAGAACTCAATGACAGACTGCTGTATCGAGACGTACCTGATGAAGAGCGAACGTAAATTCTACAGCATGTACA
ACGATGCACAATTAAAGAAACAGCCCGATGATCGTGCAGTATCTGATTCGAATTCAGACACTCAAGATAACCGCGCCTCA
TACGCCACTGTCACTGGAGGTTCGGACTCAAATGATCCGGATGAGATTGATCTATGGCTCTCTCGACTGGGGTATAAGCG
ACCGATTGCTATTCAGAGATTCATGAGAAGGCGTCTCGGCAAATGGCCTGTTTACGCTCTATTCCTGGGTCTTGGACAAA
TCATCGCGACCAACTCCGCTCAAATGACCCTGTTGGTCGGTCAGGTAGGAGAAACAGCAACGAAGTTGTACATTATCGCA
ACGATCTACTGTATTTCCTCCATCTGTTGGTGGCTCCTCTTCTATCGATTCCCGTCAGTAATCGTCCTCACTCTCCCCTG
GTTCATTTACTGCATGGCATTCATCATCATTGGCGTCTCTCCATTCGCTCTCACATCTCTCGGTCGAGCCTGGGCCCAGA
ATGTCGCTGCAGGTGTGTATTCCGCCGCATCATCTAGCGGCTCGTTATTCTTCGCCCTCAACTTCGGTGACCAGGGTGCC
GTCCCTATAAAGGATTGGATGTTCCGCGCGAGTCTCATCCAGGGAATCCAGCAGCTCTATACCGTCGCCCTATGGTACTG
GAGTTCGAAGGTAACCGAAGCAGAAGTGGGAGGCGTGTCCACCGCTGCTCTAAGCTCATGGAAACTCACAGCTGTGGTGA
TGCCCATCGCCGCAGTATGTTTCATAGTCGGCGTGCTTCTCGCGCTCGGCCTACCAAAATACTACCGTCAATCCCCGGT
AGGATCCTCTTCTTCTACACATCCCTCTTCCGCCGCCGTATCGTCCTCTGGTTCTTCTTCATGGTGATCGTCCAGAACTG
GTTCCTCTCCGCAGCATTCGGTCGCAATTGGTCATTCCTCTGGTCCTCCCAGCACGCCAAGGCATGGGAGGTTGTCATCC
TAGTCATCTTCTTCTTCGTCATCCTCTGGGTAATCATCCTCATCATCTTCCGCGCCCTGTCCAAGGAACACAGCTGGATT
CTACCCGTCTTCGGGCTGAGTCTCGGCGCACCGGCGCTGGGCCCAAACATGGTGGGAACGTCCAACATAGGCTACTACCT
GCCATGGGCAGGAAGTCTGACATCCGGTGCCCTCGTGTCGAGATGCGTCTGGCTCTGGCTCGGTGTCCTTGACGAAATCC
AGCAAGTCGGCCTGGGTATGATCCTCCTACAGACCCTGACAAGAGTCCACGTGTGCTTTGTTCTGTTGGCCGCACAGGCT
CTTGGATCCATCGCTACGATCTGTGCGCGTGGATTCGCGCCGAATAAGCTCGGTCCTGCGGGTATCTCGCCAAATGTGGG
CACGTCTTTGGATACAGTTGGAAATGCGTGGTTCTGGATCGCGCTCTTCTTCCAGCTTCTGGCTAGGTAAGGCTTTTGAA
TTTTACGGCTTTAATAAATTCAATACTAATGTGATTTATAGTTGGGGCTTCCTTTTGTTCTATCGTCGTGAGCAGCTTAA
TAGGCCTTAA
```

Fig. 30
PUTATIVE AMINO ACID SEQUENCE OF Aspergillus niger AgsE (Genbank accession No. ANI_1_360084)

MKWAISGTLLACFATTATAWPYDESLVDYNFNQNQSATNPADYWGTWPNHTGDYFPSPDNWRFPVYTLFLDRFVNGDPTN
DNINGTLFEHDLRSNQMRHGGDVAGLLDTLDYLQGMGIKGLYLAGTILMNQPWGSDGYSALDTTLLDQHYGNLQTWRNAI
TEIHKRGMYVIFDNTIATMGDLIGFDGYLNTTTPFSVKEHQTVWKTDRRYVDFDIGNDYNETCDYPRFWFEDGYPVQASV
TEELVGCYNSDFDQYGDIEAFGVFPDWQRQLAKFASVQDRLREWVPSVRERLIRHSCIIQSLDIDGFRYDKATQATVDA
LGDMSNAYRECARAVGKENFFIAGEITGGNTFGSIYLGRGRQPNQFPDSAEAAMKLTNTSDAQYFLREVGHEAIDGAAFH
YSIYRALTRFLGMDGNLAAGYDVPVDWVDAWNLMLQSNDLVNANTGKFDPRHMYGATNQDVFRWPTVEKGVERQLLGLYI
TTLLLPGIPLLLWGEEQAFYVLDATASNYIYGRQAMSPATAWRDHGCFSLESSQYYNWPIESGRQGCHDPTVAYDHRDPS
HPVRNIIKHMYQMREQFPVLNDGYTIQKLSNHTEDVYYLGSNGTATETGLWSILRDVNADVQDLGSDAKNQPVWLVYHNT
NRTIDYKFDCSDNDTALIAPFDSGTWVKNLFHPYDEHQLIDSPTKLGLNGSTAYSGCLANMTMSAYEFRAYVPKTRFTKP
RPMITKFTPGHDVPIRSTVAPNADENVEVEIYFSEEMDCDSVTKSITLSSSTEIGKAPSVDSGSVNCKSVPATNTSWTGQ
IPGVWMWAANLTGVYNGIHRLTVNNVSTESGNATTNAVDHFLFRIGQIDNPMIFSSANYSTSLLHKESNGTLFIQHHAAG
ADKYRYSTNWGTTFSDWIDYRGGNDTIEELEWSGTKKQSWKGNHVRVEYWSRWTGSSDYVQEGDAGWNENVPRRFPHVFF
NGPYNQYGYDAGLDNVVRQDSVDGLWKYHFTAEWPAQAQLNIWGMNPDGEPDQSWVLGDADNDSVLDRMPPSSLSATLIN
ITEHPPSPYISWNIFIDDGTMRFQLFPVGHQNTQIAMYVLFWIIPVITGAAGVWAFMKSFYKVKFNQVGVSEKHQMIPLA
LRRKFKRNRNRGGDEENSNPLMRLANKSGFLQTDTAIGGAASGKRRMVLIATMEYDIEDWAIKIKIGGLGVMAQLMGKTL
GHQDLIWVVPCVGGVDYPVDKPAEPMHVTILGNSYEVQVQYHVLNNITYVLLDAPVFRQQSKSEPYPARMDDLNSAIYYS
AWNQCIAEACKRFPIDLYHINDYHGSLAPLYLLPDTVPACLSLHNAEFQGLWPMRTQKEKEEVCSVFNLDIETVRHYVQF
GEVFNLLHSGASYLRVHQQGFGAVGVSKKYGKRSYARYPIFWGLRKVGNLPNPDPSDVGEWSKEQASAMGDNVSVDPTYE
AGRGDLKRQAQEWAGLEQNPDADLLVFVGRWSMQKGVDLIADVMPAVLEARPNVQLICVGPVIDLYGKFAALKLDHMMKV
YPGRVFSRPEFTALPPYIFSGAEFALIPSRDEPFGLVAVEFGRKGALGIGARVGGLGQMPGWWYNVESTATSHLLVQFKL
AIDAALSSKTETRAMMRARSAKQRFPVAQWVEDLEILQTTAIQVHNKELVKHNGRPFTPSGTTTPGGILSQPSSPLMPPG
MQTPLAHSRESSYSNLNRLSEYVTDPKTNYSRDISPSGTEKPRSGLQRQLSLGVRSGPGHQERRGRRGRQRDSIPEHEDT
AGAMTDVEEDHEDIGDQQDADDEYTLTPAQVEEGRRLQAVQQQGVGMPTSPGVRRYSQDSLHPRQLPSSPGPVPPPTQSL
LPPPRLGDAGSRLSSASVLSLDSVVGTKTDFKLQKVDPFFTDSTGEYYKAFDKRLVGLNGSNSESQLCIEEYLIKSEKEW
FDKFRDARLGRLKSPASSVFRDKHGASPVGSYYDDTGSRVSGDYDRESRDTEDDEFLLGKDYVPPTGLRKWMQIRVGDWP
VYSLFLALGQIIAANSYQVTLLTGEVGETAEKLYGIATTYLITSILWWLVFRYFKSVVCLSAPWFFYGLAFLLIGSAHFE
PNSFNRGWIQNIGSGCYAAASSSGSIFFALNFGDEGGAPVETWIFRACLIQGIQSAYIIGLWYWGSTLTKASSQGLLTST
NNIANSWKMTAICYPIAIFLWAVGLLLLFGLPNYYRQTPGKVASFYKSVFRRKIVLWNFVAVILQNFFLSAPYGRNWGFL
WSSNHAKAWQIVILCIVFYGFVWAGFLFVVSRYFKSHSWFLPVFACGLGAPRFIQIWWGVSGIGYFLPWVSGGYLGGALA
SRSLWLWLGVLDSIQGLGFGIILLQTLTRMHMLFTLICSQVLGSIATICARAFAPNNVGPGPVSPDPTFGGSAVANAWFW
VALFCQLLVCAGFLLFFRKEQLSKP

Fig. 31
BASE SEQUENCE OF NUCLEIC ACID MOLECULE OF Aspergillus niger agsE (Genbank accession No. AN1_1_360084)

```
ATGAAGTGGGCTATTTCCGGCACGCTGCTCGCCTGTTTCGCAACAACTGCAACGGCCTGGCCTTACGACGAGTCCCTCGT
CGACTACAACTTCAATCAGAACCAGTCCGCTACGAACCCGGCGGACTATTGGGGAACATGGCCCAATCATACCGGGGACT
ACTTCCCCTCCCCGGACAATTGGCGCTTCCCCGTCTACACCCTCTTTCTCGACCGCTTCGTCAACGGTGACCCCACAAAC
GACAACATCAATGGCACCCTGTTCGAACATGACCTCCGCTCGAATCAGATGCGCCATGGTGGCGATGTTGCCGGCCTGCT
GGATACCTTGGATTACTTGCAGGGCATGGGAATCAAGGTCGGTCCCTGTGGCTTGTCCGATGCTGCGATCAATTACTGAC
GATGGTTTAGGGTCTCTATCTTGCCGGAACAATCCTCATGAACCAGCCCTGGGGATCTGACGGTTATTCGGCTTTGGACA
CGACATTGTTGGATCAACACTATGGTAACCTGCAGACGTGGCGCAATGCCATCACGGAAATTCACAAGCGCGGGATGTAT
GTCATCTTCGATAACACCATCGCAACGTAAGTTTGCCGCTGCCTTTTCCCCTCTTTCCTACCCAACAAACTAACCTGCAA
TTTTTAGGATGGGTGATTTGATCGGATTTGATGGCTATCTGAACACCACCACCCCCTTCTCCGTGAAGGAACACCAAACG
GTGTGGAAGACTGACCGCCGCTATGTGGACTTCGACATTGGCAATGACTACAACGAGACGTGCGACTACCCCGCTTCTG
GTTCGAGGATGGCTACCCCGTTCAAGCGTCAGTCACCGAGGAGCTTGTCGGATGTTACAACAGTGATTTCGACCAGTACG
GTGATATTGAGGCCTTTGGTGTCTTCCCCGATTGGCAACGTCAGCTGGCAAAATTCGCCTCCGTTCAGGATCGACTCCGT
GAATGGGTTCCCTCCGTGCGCGAGCGTTTGATCCGCCACTCCTGCATCATTATTCAGTCGCTCGATATTGACGGTTTCCG
GTACGACAAGGCGACTCAGGCAACCGTCGACGCCCTGGGAGATATGTCCAATGCGTACCGCGAGTGCGCCCGCGCCGTAG
GAAAAGAGAACTTCTTCATTGCGGGCGAAATCACGGGTGGTAATACCTTTGGTTCCATCTACTTGGGCGAGGAAGACAG
CCCAACCAGTTCCCTGACTCGGCGGAGGCAGCCATGAAGCTGACCAACACTTCCGACGGCCAGTATTTCCTGCGTGAAGT
GGGACATGAGGCGATTGATGGTGCAGCCTTCCACTACTCCATTTACCGAGCGCTGACCCGCTTCCTGGGCATGGATGGTA
ACTTGGCTGCCGGTTACGATGTGCCAGTCGACTGGGTTGATGCCTGGAATCTCATGCTGCAGTCCAACGATCTGGTCAAT
GCGAATACAGGCAAGTTCGACCCCCGCCACATGTACGGGGCTACCAACCAGGATGTCTTCCGTTGGCCCACGGTGGAAAA
GGGCGTGGAGCGTCAGTTGCTTGGATTGTACATCACGACTCTTCTGCTCCCCGGAATTCCGCTCCTTCTCTGGGGCGAGG
AACAGGCGTTTTACGTACTGGATGCCACGGCATCGAACTACATCTACGGTCGGCAGGCCATGTCTCCTGCCACCGCATGG
AGGGATCATGGCTGTTTCTCCTTGGAATCGTCTCAGTACTATAATTGGCCCATTGAGTCCGGCCGTCAGGGCTGCCACGA
CCCCACGGTGGCCTACGATCATCGTGACCCGTCTCATCCCGTGCGCAATATCGATTAAGCATATGTATCAGATGCGCGAAC
AGTTCCCCGTCGCTCAATGACGGCTATACTATTCAAAAGCTCTCGAACCACACCGAGGACGTGTACTATCTCGGTTCCAAC
GGCACAGCCACCGAGACCGGACTCTGGTCGATTCTTCGTGATGTGAACGCGGATGTGCAGGATTTGGGCTCCGATGCGAA
GAACCAGCCTGTCTGGCTGGTTTACCACAACACGAACCGCACCATTGATTACAAGTTTGACTGCTCGGATAATGATACAG
CTCTGATTGCCCCCTTCGATAGTGGCACCTGGGTCAAAAACCTGTTCCACCCGTATGACGAGCACCAGCTGATCGATTCC
CCCACCAAGTTGGGATTGAACGGATCAACTGCATACAGTGGCTGCTTGGCTAATATGACCATGTCCGCCTATGAATTCCG
GGCCTACGTGCCTAAAACCCGCTTTACTAAACCCAGGCCGATGATTACAAAGTTCACTCCGGGACACGATGTCCCGATCC
GCTCGACCGTGGCCCCGAACGCAGACGAGAACGTGGAGGTCGAAATTTACTTCTCCGAAGAAATGGATTGCGACTCGGTG
ACAAAGTCCATTACCCTTTCGTCATCGACCGAAATTGGAAAGGCCCCCTCTGTCGATTCTGGCAGTGTCAACTGCAAGTC
AGTCCCCGCCACTAACACCAGCTGGACCGGCCAGATTCCCGGGGTGTGGATGTGGGCGGCCAACCTGACAGGTGTGTACA
ACGGCATTCATCGTCTCACAGTCAACAATGTCAGCACAGAGAGTGGGAACGCAACCACCAACGCCGTCGACCATTTCCTC
TTCCGCATCGGCCAGATTGATAATCCGATGATTTTCAGCAGTGCGAACTATTCAACTAGTTTGCTCCATAAGGAATCCAA
CGGCACCCTTTTCATCCAGCACCACGCCGCGGGTGCTGATAAGTATCGCTATTCTACGAATTGGGGTACCACTTTCTCCG
ATTGGATTGACTACAGGGGCGGAAATGACACTATTGAGGAACTCGAATGGTCGGGAACCAAGAAGCAGTCATGGAAAGGA
AACCACGTTCGCGTGGAGTATTGGAGTCGTTGGACCGGCAGCAGCGATTACGTCCAAGAGGGAGACGCGGGCTGGAACGA
GAATGTTCCACGCCGTTTCCCTCACGTCTTCTTCAACGGACCCTACAACCAGTATGGGTATGATGCAGGTCTGGACAACG
TGGTCCGCCAGGACAGCGTTGACGGTCTCTGGAAATATCATTTCACCGCGGAATGGCCTGCTCAAGCTCAATTGAACATT
TGGGGTATGAACCCTGATGGGGAGCCTGACCAGAGTTGGGTCCTGGGAGATGCCGATAATGATTCGGTTCTCGATCGCAT
GCCGCCCTCTTCGCTGTCCGCGACATTGATTAACATCACTGAACACCCCCCCTCTCCCTACATTTCGTGGAATATCTTCA
TTGATGACGGGACCATGCGCTTCCAGCTGTTCCCCGTCGGGCATCAGAATACTCAGATCGCCATGTATGTGCTCTTTTGG
ATCATCCCCGTCATCACGGGCGCAGCCGGTGTGTGGGCTTTCATGAAGTCTTTCTACAAGGTCAAATTCAACCAGGTTGG
TGTGAGCGAAAAACACCAGATGATCCCATTGGCCTTGCGGCGGAAGTTCAAGCGCAATCGCAATCGTGGCGGTGATGAGG
AAAACTCAAACCCTCTCATGCGTCTGGCGAACAAGTCCGGGTTCCTCCAGACTGACACGGCGATTGGTGGTGCTGCTAGC
GGCAAGCGTCGCATGGTCCTGATCGCCACCATGGAGTACGACATTGAGGATTGGGCCATCAAGATCAAGATTGGTGGTCT
TGGTGTCATGGCGCAACTCATGGGTAAGACTCTGGGTCATCAAGACTTGATCTGGGTGGTGCCTTGCGTTGGGGGTGTCG
ATTACCCCGTGGACAAACCCGCAGAGCCCATGCATGTCACCATTCTTGGCAATTCGTACGAGGTCCAGGTCCAGTATCAC
```

Fig. 32

```
GTCTTGAATAACATCACCTATGTTCTGCTGGATGCCCCTGTGTTCCGTCAACAGTCTAAGTCAGAGCCTTACCCGGCTCG
CATGGACGACCTGAACAGCGCCATTTACTACTCGGCCTGGAATCAGTGCATTGCGGAAGCCTGCAAGAGATTCCCTATCG
ACCTGTATCATATCAACGACTACCATGGTTCCCTGGCTCCACTGTATCTACTTCCTGACACAGTACCTGCCTGTCTTTCC
CTGCATAACGCCGAGTTCCAAGGTTTGTGGCCCATGCGGACGCAGAAAGAAAAGGAGGAAGTTTGCTCCGTGTTCAATCT
GGATATCGAGACCGTGAGGCATTACGTGCAGTTTGGAGAGGTGTTCAACTTGCTCCACTCGGGTGCTAGTTATCTCCGTG
TTCACCAACAAGGTTTCGGTGCTGTTGGTGTGTCTAAGAAGTACGGAAAGCGGTCCTACGCGCGTTACCCCATTTTCTGG
GGTCTCCGCAAGGTTGGAAACCTACCTAACCCTGATCCGTCTGATGTCGGTGAGTGGAGCAAGGAACAGGCCAGCGCCAT
GGGTGACAATGTGAGCGTGGACCCGACTTATGAAGCCGGTCGAGGCGACCTCAAGCGTCAAGCTCAGGAGTGGGCCGGTC
TTGAACAGAACCCTGACGCCGATTTGCTTGTCTTCGTTGGTCGTTGGTCGATGCAGAAGGGTGTTGATTTGATCGCCGAC
GTCATGCCTGCTGTCCTGGAAGCACGCCCAATGTTCAGCTCATTTGTGTTGGACCAGTTATCGATCTCTACGGTAAATT
CGCGGCCCTCAAACTCGATCACATGATGAAGGTCTACCCCGGACGAGTGTTCTCTAGACCTGAGTTCACGGCATTGCCCC
CCTACATCTTCTCTGGTGCTGAATTCGCGCTGATTCCCTCTCGTGACGAGCCCTTCGGTCTGGTCGCCGTCGAGTTCGGA
CGTAAGGGAGCTCTGGGTATCGGTGCCCGGGTTGGTGGTCTCGGTCAGATGCCAGGTTGGTGGTACAATGTGGAATCGAC
AGCTACCTCCCATTTGCTCGTTCAGTTCAAGCTGGCTATCGACGCGGCTCTCAGTTCGAAAACGGAAACTCGTGCTATGA
TGCGTGCCCGGTCCGCCAAACAGCGCTTCCCGGTCGCCCAGTGGGTGGAAGACTTGGAGATCCTGCAAACCACCGCCATC
CAAGTGCACAACAAGGAATTGGTTAAACATAACGGTCGACCCTTCACCCCGTCTGGAACTACCACGCCGGGTGGCATCTT
AAGCCAGCCGTCAAGTCCACTAATGCCCCCTGGAATGCAGACTCCCTTGGCTCATTCTCGGGAAAGCAGCTATTCTAACC
TGAACCGTCTCAGTGAATATGTCACAGATCCGAAAACAAACTACAGTCGAGACATCAGCCCCAGTGGGACGGAAAAGCCG
CGGTCCGGCCTGCAACGACAGCTTTCTCTTGGTGTTCGCTCAGGACCTGGTCATCAAGAGCGCCGTGGCCGTCGTGGACG
CCAGCGCGACAGCATCCCCGAACACGAAGACACCGCAGGGGCCATGACCGACGTCGAAGAAGACCACGAGGACATTGGGG
ATCAGCAGGATGCGGACGACGAGTACACTCTCACCCCGGCTCAGGTCGAGGAAGGACGTCGCTTGCAGGCTGTCCAGCAG
CAGGGAGTGGGTATGCCGACGAGTCCGGGCGTCCGCCGTTATAGTCAAGACTCCTTGCATCCGCGACAGCTTCCTAGCAG
CCCTGGCCCCGTCCCACCTCCTACACAGAGCCTCCTTCCGCCACCCAGGCTTGGGGATGCCGGTAGCCGACTCAGTAGCG
CGTCTGTCCTGTCCCTGGATTCGGTCGTTGGTACCAAGACGGACTTCAAGCTCCAGAAGGTTGACCCCTTCTTTACGGAT
TCTACTGGCGAGTACTACAAGGCATTCGACAAGAGGCTGGTCGGCTTGAACGGCTCGAACTCCGAATCCCAGCTTTGCAT
TGAGGAATATCTCATCAAGAGTGAGAAGGAATGGTTCGACAAGTTCCGCGATGCCCGACTGGGTCGTCTAAAATCCCCCG
CGTCGTCTGTCTTCCGGGACAAGCATGGTGCCTCCCCTGTTGGCTCCTACTACGATGATACGGGCTCCCGGGTGAGTGGT
GACTATGACCGGGAGTCCCGCGACACGGAAGATGACGAGTTCCTCCTGGGCAAGGACTACGTGCCTCCGACGGGTCTGCG
CAAGTGGATGCAGATTCGTGTTGGAGACTGGCCAGTCTACTCGTTATTCCTTGCCTTGGGTCAGATCATTGCAGCCAACT
CTTATCAGGTGACCTTGCTTACCGGTGAGGTTGGTGAGACGGCCGAGAAGCTCTATGGTATCGCAACCACCTACCTGATC
ACCTCGATCCTTTGGTGGCTTGTGTTCCGTTACTTCAAATCGGTGGTGTGCCTCTCGGCTCCCTGGTTCTTCTATGGCCT
TGCCTTCCTTCTGATCGGCTCCGCTCACTTTGAACCCAATTCATTCAACCGGGGTTGGATCCAGAACATCGGAAGTGGAT
GTTACGCCGCTGCCTCGTCTAGCGGTTCCATCTTCTTCGCCTTGAACTTTGGTGACGAAGGTGGTGCGCCGGTCGAAACC
TGGATCTTCCGGGCTTGTCTCATTCAGGGTATCCAGTCGGCTTATATCATCGGACTGTGGTATTGGGGTTCCACTCTGAC
CAAGGCATCCAGCCAGGGTCTGTTGACCTCGACGAACAACATCGCCAATAGCTGGAAGATGACGTGAGTACATTGAACCC
TCTGATTGTTCATCAATCAGCCAGTCATTCCATCTTGTGACCCGCTAACACTGATCTCCTCTAGTGCCATCTGTTACCCG
ATTGCAATCTTCCTCTGGGCTGTTGGATTGCTGCTTCTCTTTGGACTTCCTAACTACTATCGCCAAACCCCGGGCAAAGT
GGCCTCCTTTTACAAGTCCGTATTCCGCCGCAAGATCGTCCTCTGGAACTTCGTTGCCGTCATCCTGCAAAACTTCTTCC
TCAGCGCACCGTACGGCCGCAACTGGGGCTGTAAGTCTAACTTTCCCTGCCACATCGTGTCGAATTGATAAGCTAACTCT
AGTCCGCAGTCCTTTGGTCTTCCAATCACGCCAAGGCCTGGCAAATCGTTATTCTCTGTATCGTCTTCTACGGGTTCGTC
TGGGCGGGCTTCCTGTTCGTCGTCAGCCGCTATTTCAAGTCCCACAGCTGGTTCCTGCCCGTGTTTGCGTGCCGGACTTGG
AGCACCTCGCTTCATTCAAATCTGGTGGGGTGTCTCGGGCATCGGTTACTTCCTTCCCTGGGTCTCCGGAGGCTATCTCG
GCGGAGCTTTGGCCTCGAGGAGTCTCTGGCTCTGGCTGGGCGTGTTGGATTCCATCCAGGGTCTCGGGTTCGGTATCATC
CTCCTGCAGACCCTCACCCGCATGCACATGCTGTTCACCCTGATCTGCTCGCAGGTGCTTGGTTCCATTGCCACCATCTG
TGCGCGGGCGTTTGCCCCGAATAACGTCGGGGCCGGCCCTGTGTCGCCGGACCCCTACCTTTGGAGGAAGTGCAGTGGCCA
ATGCGTGGTTCTGGGTGGCCCTGTTTTGTCAGCGTTGGTGTGTGCTGGCTTCCTCCTCTTCTTCCGGAAAGAGCAGCTT
TCCAAACCTTGAACGCCTTAATGATGTGGTGGTGCGCTTGGGCACCACCGGGCATGAACATTTAACATACGTCCCACCAT
TCCTTCCTTCCTTCCCTCCCTACCTACGCCCCTTGGATATAATTTTACTGTCTGTCATAATATAATCTCTCCTGTATGTA
```

Fig. 33
PUTATIVE AMINO ACID SEQUENCE OF Aspergillus fumigatus Ags1    (Genbank accession No. AFUA_3G00910)

```
MKWGWTGALLAWFATTTSCWPYDESLVGYNLNENKEAKSPVEYWGEWPDHKGKYFPSPENWRFPFYTLFLDRFVNGDPEN
DNINGTQFEHDISSNQMRHGGDVAGLVATLDYLQGMGIKGIYLAGTILMNQPWGADGYSTLDTTLLDQHFGNIDTWRNAI
TEIHKRGMYVIFDNTIATMGDLIGFEGYLNTTTPFSVKEHKALWKTDRRYVDFDIGNDYNSTCDYPRFWYEDGLPLPSEQ
ADQLVGCYNSDFDQYGDIEAFGVFPDWQRQLAKFASVQDRLREWIPSVRERLIRHSCIIIASLDIDGFRYDKATQATVDA
LGEMSMAYRECARAVGKNNFFISGEITGGDYFGSIYLGRGRQQNQWLPDPSQGPKMTNESSAQYFLREAGHEALDSAAFH
YSVYRTLTRFLGMDGNLAAGYDVPLDWVDMWRQMLRSNDLVNANTGKFDPRHMYGATNQDVFRWPTVQWGVERQLLGSYI
TTLLLPGIPLLLWGEEQAFYVLDATATNYIYGRQAMSPATAWRDHGCFSLNSSQYYKWPIQAGREGCHDDTVAYDHRDPS
HPVRNILKHMYQLREQFPVLNDGYTLNNLSKSTFPVQYPGSNGTETETGMWSVSREANLEVQDFGSDDLNSPVWMVYQND
NHTVDYKFDCNSETDALIAPYPADTVVKNLFYPWDEFTLTAGPTKRTFGNATLPAGCYGNLTLKAFEFRAYVPKKLHRKP
RPMITKFSPGHDVPIASTVAPDASENVPIELHFSEEMDCDGVTKSISLTSSTESLKVPSIDAGSVHCERITNFNTSWTAQ
IPSMWKWQATLTNVYNGIHQITVKEPKTSSGNASTNSTDHFLFRIGQVDNPMVFTRANYSTSLLHEYENGTLFIQHHAAG
ADKYRYSTNWGTTWSSWTKYHGGNDTIEELPWQGTKEQRWEGKHVRVEYWSGLTGSSDYYQEGDVGWPHQVPRRFPHIHF
NGPFNQFGYDGGLPNKLKLDTTTGHWKYHFTYEWPAQAQINVWGMNPDGRPDQSWVLGDIDGDHVLDRMPPSSLSATMIN
ITDLPPSPHLAWIISINDGTMRYTLEPTGDQSTQMAMYILFWIVPLLTGAVCVYVFMKSFYQVKFNQVGVSEKRTLIPLA
LRRKLKRARNGEGEAMNPLMRLANKSGFLQSATDLTAASGGSKRRMVLIATMEYDIEDWAIKIKIGGLGVMAQLMGKTLG
HQDLIWVVPCVGGVDYPVDRPAEPMIVTILGKPYEVQVQYHILQNITYVLLDAPVFRQQSKSEPYPPRMDDLDSAIYYSA
WNQCIAQTIKRFPIDLYHINDYHGSLAPLYLLPQTIPACLSLHNAEFQGLWPMRTEKEKEEVCSVFNLDKEITRRYVQFG
EVFNLLHAGASYLRVHQQGFGAVGVSKKYGKRSYARYPIFWGLKKVGNLPNPDPSDVGEWNKEKALAKSEDPPVDQEFEA
GRAELKRQAQEWAGLEQNPDADLLVFVGRWSMQKGVDLIADVMPAVLEARPNVQLICVGPVIDLYGKFAALKLDRMMKVY
PGRVFSRPQFTALPPYIFSGAEFALIPSRDEPFGLVAVEFGRKGALGIGARVGGLGQMPGWWYNVESMTTAHLLHQFKLA
IEGALNSKPEVRAKMRARSAKQRFPVAQWIEDLEILQSTSIRIHNKEASKSNNRPVTPTGPMTPRGLGTMSPTFPGSGTQ
TPVGTHSREASYVNLRQLSEIGPQQRDTIISYSNNNAGREMTEKPAPGLSRKLSLGVRSGPGHINRPGRRGQGQQDLALP
DRRDGGDVSDIEEESDEDFIDQYYGDEEYTLTPEQAEEGRRLQNNPQSQSGRATPRELTRSSQFPSSPSVHSDMGLAPPT
RPFLEPGNRLSSASVLSVDSVVGDKKDFKLQKVDPFFTDSHGEYARLFENSLENLNAANSETQLCIEEFLVKSEKEWFDK
FRDAKLGRLNSPAPSVFRGKRGPSPVDSYYGDDASSRMSPDDEQSQEDDEFLLGKDYVPPTGLRKWMQLRIGDWPVYSLL
LGLGQIIAANSYQITLLTGEVGQTAEKLYGIATTYLITSILWWFVFRYFKSIVCLSVPWFFYGLAFLLIGLAHFDHNEFS
RGWIQNVASGFYATASSSGSIFFALNFGDESGAPVKEWVFRACVIQGTQQAYVIALWYWGSTLTKASSQGLLTAETNIAN
TWKMTAICVPITVFLWCVGLLMFFGLPNYYRQSPGKVPSFYRSVFRRKIVIWNFAVVIIQNFFLSAPYGRNWNFLWSSAH
AKTWQIVILCIVFFGFVWAGFLFVLSHLSKKHSWILPVFACGLGAPRWAQIWWGVSGIGYYMPWVAGGLTGGALASRSIW
LWLGVLDAIQGLGFGMILLQTLTRMHMCFTLIVCQVLGSIATICARAFAPNNVGPGPISPDPTYGASAVANAWFWIALIF
QLLICAGFLLFFRREQLAKP
```

Fig. 34
BASE SEQUENCE OF NUCLEIC ACID MOLECULE OF Aspergillus fumigatus ags1 (Genbank accession No. AFUA_3G00910)

```
ATGAAGTGGGGATGGACCGGGGCGTTGCTGGCCTGGTTTGCGACAACCACATCATGCTGGCCGTATGACGAGAGCCTGGT
CGGGTACAACCTCAACGAGAATAAAGAGGCCAAAAGCCCCGTGGAGTACTGGGGAGAATGGCCGGACCATAAGGGCAAAT
ACTTTCCCTCCCCGGAAAACTGGCGGTTTCCATTTTACACCCTGTTTTTGGATCGATTCGTGAACGGTGACCCGGAGAAT
GATAATATCAACGGGACGCAGTTCGAGCATGATATCAGCTCCAACCAGATGCGTCACGGTGGTGATGTCGCCGGGTTGGT
CGCTACTTTGGACTACTTACAGGGCATGGGGATCAAAGTAGGTTTTCCTGACCTGACTGATCTGTGGCCGCAATGAGATG
CTGACTCCGACAGGGCATTTATCTGGCCGGAACGATCCTTATGAACCAGCCCTGGGGCGCAGACGGTTACTCGACATTGG
ATACAACGCTTTTGGATCAGCATTTTGGTAACATCGACACCTGGCGCAACGCGATCACGGAGATCCACAAGCGCGGGATG
TATGTGATATTCGACAATACTATTGCCACGTAAGTCTCCCCAAACCCCATTCTCTGCGTGCGGACTGACGCAAATACAAG
CATGGGTGATCTCATTGGCTTCGAAGGCTATCTCAACACCACCACCCCCTTCTCGGTCAAGGAGCACAAGGCCCTCTGGA
AGACCGATCGTCGCTACGTGGATTTTGACATTGGCAACGACTATAACTCAACCTGCGATTACCCCCGTTTTTGGTATGAG
GACGGTCTTCCGCTTCCCTCCGAGCAGGCCGATCAGCTGGTGGGCTGCTACAACAGCGATTTCGACCAGTACGGTGACAT
TGAAGCGTTCGGTGTGTTCCCCGATTGGCAGCGTCAGTTGGGCAAGTTCGCGTCCGTGCAGGATCGTCTGCGAGAATGGA
TCCCGAGCGTGCGAGAGCGACTGATCCGTCACTCTTGCATAATCATCGCCTCCCTGGATATTGATGGTTTCCGGTACGAT
AAAGCCACCCAGGCGACGGTTGATGCTCTCGGCGAAATGTCCATGGCATACCGGGAGTGTGCCCGTGCCGTGGGCAAGAA
CAACTTCTTCATCTCGGGAGAAATTACCGGTGGTGATTACTTCGGTTCCATCTACCTCGGACGGGGCAGACAGCAGAACC
AGTGGCTTCCGGACCCTTCCCAGGGTCCCAAGATGACGAATGAGTCCAGCGCCCAGTATTTCCTGCGGGAGGCGGGCCAT
GAAGCCCTTGATAGTGCTGCGTTCCACTATTCCGTTTACCGCACCTTGACCCGTTTCCTGGGTATGGACGGCAATCTCGC
CGCCGGTTACGATGTCCCTCTGGATTGGGTCGACATGTGGCGGCAAATGCTCCGGTCGAACGACCTCGTTAATGCGAACA
CAGGCAAGTTCGACCCCCGGCACATGTACGGTGCGACCAACCAGGATGTCTTCCGGTGGCCAACTGTGCAATGGGGCGTG
GAACGGCAATTGTTGGGTAGTTATATCACAACACTGCTCCTTCCCGGCATCCCTCTTTTGCTCTGGGGTGAGGAGCAGGC
CTTCTATGTGCTGGATGCCACTGCTACTAATTATATTTACGGTCGTCAGGCCATGTCGCCTGCAACTGCCTGGAGAGACC
ATGGCTGCTTCAGTCTGAACTCCTCGCAGTACTACAAATGGCCGATTCAAGCTGGCCGGGAAGGTTGCCACGATGATACA
GTCGCCTATGATCATCGGGACCCTTCTCACCCAGTGCGCAACATGCTCAAGCACATGTATCAGTTGCGTGAGCAATTTCC
CGTTCTTAATGACGGTTACACCCTCAACAACTTGTCCAAGTCGACCTTTCCCGTGCAGTACCCGGGTTCTAACGGAACCG
AGACCGAGACCGGAATGTGGTCTGTCAGTCGCGAAGCCAACCTGGAAGTGCAGGATTTCGGATCCGATGACCTGAATTCG
CCTGTTTGGATGGTCTACCAGAATGATAACCATACGGTGGATTACAAGTTCGATTGCAACAGCGAGACCGATGCTTTGAT
TGCTCCCTACCCTGCCGACACCGTCGTCAAGAACTTGTTTTACCGCTGGGATGAGTTCACCTTGACCGCCGGCCCAACCA
AACGGACCTTTGGAAATGCGACATTGCCTGCTGGCTGCTATGGCAATCTGACCCTCAAAGCATTTGAGTTCCGGGCCTAC
GTGCCAAAGAAGTTACATCGGAAGCCTCGCCCGATGATCACCAAATTCAGCCCGGGCCACGACGTTCCCATTGCTTCCAC
GGTTGCGCCTGATGCTTCCGAGAATGTGCCCATTGAGCTGCATTTCTCCGAGGAGATGGATTGCGATGGGGTCACCAAGT
CGATTTCCCTGACCTCCTCCACCGAGTCACTCAAAGTCCCATCCATCGACGGTGGCTCTGTACATTGCGAGCGTATTACC
AACTTCAACACCTCGTGGACTGCTCAGATTCCTAGCATGTGGAAGTGGCAGGCTACTTTGACGAATGTCTACAACGGTAT
CCACCAGATCACTGTGAAGGAACCCAAGACTAGCAGTGGCAACGCCTCCACCAACTCCACCGATCACTTCCTTTTCCGCA
TTGGCCAGGTCGATAATCGGATGGTCTTCACCGAGAGCCAACTACTCGACTAGTTTGCTCCATGAGTATGAGAACGGGACT
CTGTTCATCCAGCACCACGCTGCAGGCGCGGATAAATACCGCTACTCGACCAACTGGGGAACCACCTGGTCGAGCTGGAC
CAAGTACCATGGCGGTAACGACACCATCGAAGAGCTGCCGTGGCAAGGCACCAAAGAACAGCGGTGGGAAGGCAAACACG
TCCGCGTGGAATACTGGAGCGGCTTGACCGGTAGCAGCGACTACTACCAAGAAGGTGATGTGGGCTGGCCCCACCAAGTG
CCCCGTCGATTCCCTCATATCCATTTCAACGGTCCTTTCAACCAGTTTGGCTACGATGGCGGTCTCCCCAACAAGCTCAA
GCTGGACACCACCACTGGGCATTGGAAGTACCACTTCACCTACGAGTGGCCTGCACAAGCTCAGATCAACGTCTGGGGCA
TGAACCCCGATGGCAGGCCGGACCAGAGTTGGGTGCTGGGCGACATCGACGGTGACCACGTTTTGGACCGGATGCCCCCG
TCGTCTCTGTCGGCGACCATGATCAATATCACGGACCTTCCGCCGTCACCTCACCTCGCGTGGATCATCTCGATCAACGA
CGGGACCATGCGGTATACGTTAGAACCCACCGGTGATCAAAGTACGCAGATGGCCATGTACATTCTCTTCTGGATTGTGC
CCTTGCTCACAGGTGCGGTGTGCGTCTACGTGTTCATGAAATCCTTCTACCAGGTCAAGTTCAACCAGGTCGGTGTCAGC
GAAAAGCGGACGCTCATTCCCCTGGCCCTTCGGCGGAAGCTGAAGCGTGCCCGTAATGGCGAGGGTGAGGCAATGAACCC
CCTGATGCGCCTGGCCAACAAGTCCGGTTTCCTCCAGAGCGCGACGGATCTCACAGCCGCTTCGGGCGGTTCCAAACGCC
GCATGGTCCTCATTGCCACGATGGAATACGATATCGAGGACTGGGCCATCAAGATCAAAATCGGTGGTCTCGGTGTCATG
GCTCAACTGATGGGCAAGACCCTCGGCCACCAGGATCTCATTTGGGTCGTTCCCTGCGTCGGTGGAGTGGACTACCCTGT
```

Fig. 35

```
TGACCGGCCCGCGGAACCCATGATCGTCACCATTCTGGGCAAACCGTATGAGGTCCAGGTGCAGTACCACATCCTGCAGA
ATATCACCTACGTCCTGCTGGATGCGCCGGTTTTCCGTCAACAGTCCAAGTCAGAGCCCTACCCACCGCGTATGGATGAC
CTCGACAGTGCTATTTACTATTCGGCGTGGAATCAGTGCATTGCTCAGACTATCAAGCGGTTCCCCATTGACCTCTACCA
TATCAACGATTACCACGGATCCCTCGCACCCCTCTATCTCCTGCCGCAAACGATCCCCGCCTGTCTGTCTCTGCACAACG
CCGAGTTCCAGGGTCTCTGGCCCATGCGGACAGAAAAGGAAAAGGAAGAGGTTTGCTCCGTCTTCAACCTGGATAAGGAA
ATCACCCGCCGCTACGTTCAGTTCGGTGAGGTTTTCAATCTGCTGCATGCCGGTGCCAGTTATTTGCGTGTCCACCAGCA
AGGATTCGGTGCTGTCGGTGTGTCGAAGAAGTACGGTAAACGTTCGTATGCTCGGTATCCCATCTTCTGGGGCCTGAAGA
AGGTCGGCAACCTGCCCAACCCTGATCCTTCCGACGTTGGCGAGTGGAACAAGGAAAAGGCCCTCGCCAAGAGTGAGGAC
CCACCTGTCGATCAGGAATTCGAAGCCGGTCGTGCTGAGCTCAAGCGCCAGGCTCAAGAATGGGCTGGCCTGGAGCAGAA
CCCGGACGCTGATCTCCTCGTGTTCGTTGGTCGGTGGTCCATGCAGAAGGGTGTAGATCTGATTGCGGATGTCATGCCTG
CTGTTCTTGAGGCTCGTCCTAATGTTCAGCTGATCTGTGTCGGCCCTGTCATCGACCTGTACGGCAAGTTCGCTGCCCTG
AAGCTGGACCGTATGATGAAGGTCTATCCCGGCCGTGTCTTCTCTCGTCCTCAGTTCACTGCTCTGCCCCCCTACATCTT
CTCCGGTGCTGAATTCGCCCTCATTCCCTCCCGTGACGAACCGTTCGGTCTGGTCGCCGTCGAATTCGGCCGTAAGGGTG
CTCTCGGTATCGGTGCTCGCGTCGGTGGTCTCGGTCAGATGCCTGGTTGGTGGTATAATGTCGAGTCAATGACCACCGCC
CATCTGCTCCATCAGTTCAAGCTGGCGATTGAGGGTGCTTTGAACTCGAAGCCCGAGGTCCGTGCTAAGATGCGTGCTCG
TTCGGCTAAGCAGCGGTTCCCGGTCGCCCAATGGATTGAGGATCTTGAGATCCTGCAATCTACATCCATCCGAATCCACA
ACAAGGAGGCCTCCAAGTCCAACAATCGTCCCGTGACTCCTACCGGCCCCATGACCCCTCGGGGACTGGGTACGATGAGC
CCAACTTTCCCCGGTAGTGGAACCCAGACCCCGGTTGGCACGCACTCTCGCGAAGCTAGCTACGTGAACCTGAGGCAATT
GTCAGAAATTGGGCCACAGCAGCGCGACACCATCATTTCCTACAGCAACAACAACGCTGGTCGGGAGATGACTGAGAAGC
CTGCGCCGGGATTGAGCCGAAAACTGTCGCTTGGTGTCCGTTCCGGCCCTGGTCATATTAACCGTCCTGGTCGGCGTGGA
CAGGGACAGCAGGACCTCGCTCTGCCCGATCGCAGAGACGGCGGAGATGTTTCCGATATCGAGGAGGAGAGTGACGAGGA
CTTCATTGATCAGTACTATGGCGACGAGGAATATACCCTCACACCCGAGCAGGCTGAGGAAGGTCGACGACTCCAGAACA
ACCCCCAGTCCCAAAGTGGACGTGCCACCCCGAGAGAACTTACCCGCTCCTCCCAGTTCCCCTCAAGCCCGTCCGTTCAT
TCTGATATGGGTCTTGCTCCCCCCACCCGGCCATTCCTGGAACCTGGCAATCGTCTGAGCAGTGCCTCGGTGCTGTCCGT
CGATTCCGTCGTTGGTGACAAGAAGGACTTCAAGCTGCAAAAGGTTGATCCTTTCTTTACCGACAGCCACGGTGAATACG
CTCGCCTGTTCGAAAATAGTCTGGAGAACCTGAACGCGGCCAACTCGGAGACACAGCTCTGCATTGAAGAGTTCCTCGTC
AAGAGTGAAAAAGAATGGTTCGACAAGTTCCGGGATGCCAAGCTGGGCCGTCTGAACTCGCCCGCTCCATCTGTCTTCCG
TGGTAAGCGTGGTCCTTCGCCTGTGGATTCCTACTACGGGGATGACGCCTCGTCGCGTATGAGCCCGGATGATGAGCAGT
CCCAGGAAGATGACGAATTTCTCCTAGGCAAGGACTATGTCCCTCCGACCGGTCTGCGCAAGTGGATGCAGCTGCGCATT
GGAGATTGGCCCGTCTATTCCCTGTTGTTGGGCTTAGGCCAGATCATCGCCGCCAATTCGTACCAGATCACCTTGCTGAC
CGGCGAGGTTGGTCAAACTGCGGAGAAGCTGTATGGAATCGGCCACCACATACCTGATTAGCCTCGATCCTGTGGTGGTTTG
TCTTCCGTTACTTCAAGTCCATCGTCTGTCTCTCCGTCCCCTGGTTCTTCTACGGTCTGGCGTTCCTTCTCATTGGCCTC
GCCCATTTCGACCACAATGAGTTCTCCCGGGGATGGATCCAGAACGTCGCCAGTGGCTTCTACGCGACCGCTTCCTCCAG
CGGGTCGATTTTCTTCGCCCTCAACTTTGGTGATGAAAGCGGGCGCGCCGGTCAAAGAATGGGTCTTCCGTGCTTGCGTTA
TCCAGGGCACGCAGCAGGCTTATGTCATTGCGCTGTGGTACTGGGGTTCGACGCTCACCAAGGCCTCGAGCCAGGGCCTC
TTGACCGCCGAGACCAACATCGCCAACACCTGGAAGATGACCGCCATCTGTGTTCCGATTACCGTGTTCCTGTGGTGTGT
CGGTCTGCTCATGTTCTTTGGCCTGCCCAACTACTACCGCCAGAGTCCTGGTAAGGTTCCGTCCTTCTATCGGTCGGTGT
TCCGCCGCAAGATCGTCATCTGGAACTTTGCCGTCGTCATTATCCAAAACTTCTTCCTCAGTGCTCCTTACGGCCGCAAC
TGGAATTGTAAGTCACCTTCATCGGTCCACGTGAATGAAGATCCTAACCCCCTGTTACAGTCCTCTGGAGTTCGGCCCAC
GCAAAAACATGGCAGATCGTCATTCTCTGCATTGTCTTCTTCGGTTTCGTCTGGGCCGGCTTCCTCTTCGTCCTCAGCCA
CCTCTCCAAGAAACACAGCTGGATCTTGCCCGTGTTCGCCTGCGGTCTCGGTGCCCCCGCTGGGCCCAGATCTGGTGGG
GTGTCTCGGGCATCGGGTACTACATGCCCTGGGTCGCCGGCGGGCTCACGGGTGGCGCCCTGGCGTCTCGCAGCATCTGG
CTGTGGCTGGGCGTTCTCGACGCAATCCAGGGGCCTGGGTTTCGGTATGATCCTGCTGCAGACCCTGACCCGCATGCACAT
GTGCTTCACCCTCATTGTGTGCCAAGTGCTGGGATCCATCGCCACCATCTGCGCCCGAGCCTTTGCCCCCAACAACGTCG
GCCCGGGCCCTATCTCCCCCGATCCCACCTATGGTGCGAGTGCCGTGGCGAACGCGTGGTTCTGGATCGCCTTGATCTTC
CAGCTGCTCATCTGGTAAGTTTTTATTTTGCACCTCTATCTATCGATATTGAACATGGCTAATCCATTGCAGTGCTGGGT
TCCTTCTCTTCTTCCGCAGGGAACAGCTCGCCAAGCCCTAA
```

Fig. 36

PUTATIVE AMINO ACID SEQUENCE OF Aspergillus oryzae Uge3 (Genbank accession No. AOR_1_2588174)

MESPRQSDASTPVEPYSPGCVDTPATQSSVLFDGNLEELLRNFPLDQYILVTGGLGFIGSHTTLELLKANYNVIVIDNLS
NAFQNVFDRIKLLASKHHEQQGTKMPEMHLHAHDYRDSVALRKLLEQYQIQSRWGTPKTKISGVIHFAAHKAVEESIRNP
LKYYANNVGGLIDFATTLGEFGIKTFVFSSSATVYGTLATSGLPLKEELCVHKDEIFEDRDGSKKLMEPGCTGITNPYGR
TKWICEAILADLAASDPEWTIVALRYFNPVGCDESGLLGEDPKQIPTNLLPVVVKVMTGQYKELQMFGTDWDTEDGTAVR
DFIHVTDLARGHIAALSAANEGKLKENFRTFNLGTGTGHSVMEVVNTMESVSSKAIPRRAADRRAGDVGSCVAVATRSQE
ELQWKTEKTLTDACASLCNFLAVSGLSS

BASE SEQUENCE OF NUCLEIC ACID MOLECULE OF Aspergillus oryzae uge3 (Genbank accession No. AOR_1_2588174)

ATGGAGAGCCCTCGACAGTCTGACGCAAGTACTCCCGTGGAGCCTTATTCTCCAGGATGCGTCGATACACCAGCGACGCA
GTCATCCGTCTTGTTCGATGGAAATCTTGAAGAGTTGCTGCGCAACTTCCCCCTGGATCAATACATCCTCGTCACCGGCG
GTCTCGGTTTCATTGGAAGTCACACAACATTGGAGCTACTCAAGGCCAATTATAACGTAATCGTCATTGACAACCTTAGC
AATGCTTTCCAGAACGTCTTCGATCGCATCAAACTCCTGGCTTCCAAGCACCATGAGCAACAAGGAACCAAAATGCCCGA
GATGCATCTGCATGCCCATGATTACCGCGACAGTGTTGCTCTTCGCAAGCTTCTTGAGCAATATCAAATCCAGTCGAGGT
GGGGTACACCTAAGACCAAGATCTCCGGCGTCATCCATTTTGCTGCCCACAAGGCGGTTGAGGAGAGTATCAGGAATCCT
TTGAAGTACTACGCAAACAATGTCGGCGGTCTCATCGACTTTGCCACGACGCTGGGTGAGTTTGGTATCAAGACCTTCGT
CTTCTCGTCATCCGCCACCGTATACGGAACTTTGGCAACCTCCGGTCTTCCTCTTAAGGAGGAGCTTTGTGTCCACAAGG
ATGAGATCTTCGAAGACCGTGACGGGTCCAAGAAGCTCATGGAGCCTGGGTGCACAGGTATCACAAACCCCTATGGACGC
ACAAAATGGATCTGCGAAGCCATCTTAGCCGACCTCGCGGCCTCCGATCCAGAGTGGACCATCGTGGCTCTACGATACTT
CAACCCAGTTGGATGCGATGAATCCGGCCTTCTCGGTGAAGATCCCAAGCAAATACCTACCAACCTTCTTCCAGTTGTCG
TCAAGGTCATGACTGGGCAGTACAAGGAGCTGCAGATGTTTGGAACCGACTGGGACACGGAAGATGGCACAGCTGTCCGT
GACTTCATCCACGTCACCGATCTGGCTCGAGGACATATCGCAGCCCTCAGTGCTGCCAATGAAGGGAAGCTCAAGGAGAA
TTTCCGCACATTCAACCTCGGAACCGGTACAGGCCATTCCGTAATGGAGGTGGTGAACACTATGGAGAGTGTGTCTTCCA
AAGCAATTCCGAGAAGAGCTGCTGACCGCCGTGCGGGTGATGTCGGTTCCTGCGTTGCTGTGGCCACCAGGTCACAGGAG
GAGCTGCAGTGGAAGACCGAGAAGACATTGACCGATGCCTGTGCCAGTTTGTGCAATTTCCTGGCTGTCAGCGGACTGTC
CTCTTAG

Fig. 37

PUTATIVE AMINO ACID SEQUENCE OF Aspergillus oryzae Sph3 (Genbank accession No. AOR_1_2586174)

MATMGPDKHVSGRRCLQSRRSRIILGAFVFIAILAVVIPPAVVVTLRKKNSMGPKANIFVPLYVYPAPGAWDPLEAEISS
HPEANFTVVINPSSGPGPNALPDANYTREIPKLASYDNVRLLGYVPTTWAKRNISAVRRDIATYAEWPTNSSNPKLAVRG
IFFDETPQQYDADALSYLQELTSFVKGLSGLGPDNFIVHNPGAVPDSRYMSSADSTVVFEAAYDTFNERDGTKQFDVLPK
SDRGRGQLCIVIHSVPDGVEGSKLRDLVKKLRKTADEIFITHLSTDYYANFGDRWGEFVDWMAK

BASE SEQUENCE OF NUCLEIC ACID MOLECULE OF Aspergillus oryzae sph3 (Genbank accession No. AOR_1_2586174)

AATCCACTTTCTTGCCCTCCTTTCGTTGCATTCTAAGGCATTCACATTTTAATTGCCTACCTCACATGGCAACGATGGGG
CCAGACAAACACGTGAGCGGTCGTCGTTGCCTGCAAAGCCGACGTTCTCGAATCATTTTGGGGGCCTTTGTCTTTATTGC
TATCCTCGCGGTCGTTATACCTCCCGCAGTCGTCGTCACCCTACGCAAGAAGAACAGCATGGGCCCTAAAGCTAACATTT
TCGTCCCTCTCTATGTGTACCCTGCCCCTGGCGCCTGGGATCCATTGGAAGCAGAGTATGTCTGATTTTTTTTTTTATG
TCTATTTGTATTTCTAATTCTTACCTTCAATTTCACCCCCACTACTCCCCCTCACCCCCCAAAGCCCAATATGTTCTGGT
CCCTGGGGTATATACATTATACACCATAAGCAAGCTGAAAGCCAATTGCATGATGCATGCAAGCGGGAAGCTATAATTTT
GGGGGAAAGTAACTAAGCGCCACAGGATCTCTTCACATCCGGAGGCCAACTTTACCGTTGTGATTAACCCTAGCAGCGGC
CCAGGGCCCAATGCCCTGCCCGATGCTAATTATACCCGAGAGATTCCCAAGCTCGCCTCTTATGACAACGTGCGTCTCTT
AGGTTATGTCCCTACAACCTGGGCTAAACGCAACATCTCGGCCGTGCGTCGCGACATCGCAACCTACGCAGAATGGCCGA
CCAACAGTTCGAACCCTAAGCTCGCGGTTCGGGGTATATTCTTTGATGAGACGCCCCAACAGTATGATGCCGATGCGTTG
TCATATTTGCAAGAGCTCACCTCATTCGTGAAAGGCCTTTCTGGTCTTGGTCCAGACAACTTTGTATGTGTGACCCTTCT
CTTTCACCCCTCTGTAATTTGTATTACCGCTCGGTATTCATGGTAATTTACATGGGTACATACCTCATGCCCCCTGTATT
CCTTCTCCACCCTCTGTTTACTTTTCTTTTTATGCTTTTTCACTTTTGCCTCTCGGACAGTCAATATGGCCCATACCTGT
CTTTTTGATGGCGCTAGGTTCTATTACGGTTTCCAACTGCAACTCCGACAACCTCATTGGGTCAAGTTGGTCAACGATGA
TGCTAATAGTGACTGGCTAGATTGTCCATAACCCGGGAGCCGTTCCAGACTCTCGTTACATGTCTTCAGCTGACTCGACT
GTCGTATTCGAAGCGGCTTATGACACCTTCAACGAGCGTGATGGCACGAAGCAATTCGACGTTCTTCCGAAGAGCGATCG
CGGTCGCGGTCAGCTCTGCATTGTGATCCACTCCGTTCCGGATGGGGTTGAAGGTTCGAAGCTTCGTGATCTCGTCAAGA
AGCTTCGCAAGACCGCCGATGAGATTTTCATTACCCACCTGAGCACGGATTACTATGCCAACTTCGGGGATAGGTGGGGC
GAGTTTGTCGATTGGATGGCTAAATAATTCCTACGGGCGGCGCTTTTCGAGCATACCTGATGCAACATTGCTTATGATCA
GGGCCCGATTGGCGTCGACTGATAATATATGCGCCGGCGCTTTCTTTTGATGGATTGGATTGACTAATTAACTTACGACC
TGTCTATACTGTATGAACGTCTATATCCTGTATGATGATTCTACTGATAATATGCTATTTGACTTTGGCCGTTGGGACTA
TCAAATGATACCTAGAATTACGATAGAGTTTACGATCGTCAAGATTTCCTTTTTGTTTTCTC

Fig. 38
PUTATIVE AMINO ACID SEQUENCE OF Aspergillus oryzae Ega3 (Genbank accession No. AOR_1_2584174)

MAGIDEALPLKGKGQAASGWKTWSVKKRMLIIGAIALVIALAIGLGVGLGVGLNKGGGDDEGEVPPTTGGGVTTAKWQPA
VGTKWQIELLYALNDTSVDADIYDIDLFNNDKSTITDLQKQGRKVICYFSAGSYENWRPDKDKFKDSDMGNTLDGWPNEK
WLDLNSKNVRSIMTSRLDMAVEKNCDGVDPDNVDAYDNDNGLDMKKEDSANFMMWLANEAHARNMSIGLKNAGAIISAVI
DNMQWSVNEQCAQYEECDTYAAFIDKNKPVFHIEYPKGDDTNNNDLVSTSQKKSACDFEGSSNFSTVIKNMNLDNWIQTC

BASE SEQUENCE OF NUCLEIC ACID MOLECULE OF Aspergillus oryzae ega3 (Genbank accession No. AOR_1_2584174)

CCGCAGGTGACCTCGAAACAACAGCCACTGTGGCAGAGTCCATTATTTGGACATTGACTGCCGCAGTCTGTAAGGCATTC
ACTTGCCTTTAATTCCAACCCAGGACAGGCGTCTCTGCATCCGATTCCCCGGACCACCTCAACGCAATCTCTGAACGAGC
CACTTCATAGTTTCAGTGTAACCGCGGAGAGAGGGATTTCTTTGTCCTCTCCTAGCCTATACATTTAACGGTTGCCTGTG
AACCCCTGTGGTTCTACTCCGGAATACGCCACTTCATTTGCTTCTTTATCTGATCGTTTGATCTTCCTCTCAGGTCCTCT
TTATATTTTCCCTGCTTACCCCCCACCTTACCGCTGTGGTTTGTGAGAATCAAATCGCAGGTCGTACCTTTCTTTCTCGG
AATTCCCTTCTTTGAACATTTCTTTCTTTAGTCGTTCGTTTTACAGGAATTTTTCTTTGTGAAATCTATTGCACTATGGC
GGGTATTGATGAAGCGCTGCCCTTGAAGGGTAAGGGACAAGCCGCGTCCGGCTGGAAGACTTGGTCCGTCAAGAAGCGCA
TGCTGATTATCGGCGCTATCGCTCTCGTGATCGCTCTCGCTATTGGTCTAGGAGTTGGCTTGGGAGTCGGTCTGAATAAG
GGTGGAGGGGATGACGAAGGCGAGGTTCCGCCCACTACCGGAGGAGGCGTGACCACAGCCAAGTGGCAACCGGCCGTAGG
AACGAAATGGCAGATCGAGCTTCTGTACGCGCTCAACGACACTTCAGTAGACGCAGATATCTACGACATTGATCTCTTCA
ACAATGACAAGTCGACCATCACCGATCTACAAAAGCAAGGACGCAAGGTGATCTGCTACTTCTCCGCTGGGAGCTACGAG
AACTGGAGGCCCGACAAGGACAAGTTCAAGGACTCCGATATGGGTAACACGCTGGATGGGTGGCCGAATGAGAAATGGCT
TGACCTCAACTCCAAGAACGTGCGGAGCATTATGACGTCGCGTCTGGATATGGCGGTCGAGAAGAACTGCGATGGAGTTG
ACCCGGATAACGTCGATGCCTATGACAACGACAACGGTCTCGATATGAAGAAGGAGGATTCGGCGAATTTCATGATGTGG
CTCGCCAATGAAGCGCATGCACGCAATATGTCCATTGGTCTGAAGAATGCCGGGGCGATCATCTCCGCAGTGATCGACAA
CATGCAGTGGAGCGTGAACGAGCAATGCGCGCAATATGAGGAGTGCGATACCTATGCCGCATTCATCGATAAGAACAAGC
CCGTCTTCCACATCGAGTACCCCAAGGGCGACGACACCAACAACAACGATTTGGTCAGCACGAGCCAGAAGAAGAGTGCT
TGCGACTTCGAGGGATCCTCCAACTTCTCGACGGTCATCAAGAATATGAATCTGGATAACTGGATCCAGACCTGCTAGTC
GCACAATTGATCCGCATCTAAATACTCTGTTCGATCAGCAAGGGCGCCGGGAGTTTGAGATTGGGGTTCCACCATCCCCT
TACCATCTATATAGTTTGACTATGATGTAATCTGCCTCATTTAATTAACTTGGACATTCGTCTCTTTCA

Fig. 39

PUTATIVE AMINO ACID SEQUENCE OF Aspergillus oryzae Agd3 (Genbank accession No. AOR_1_2582174)

MVLPWLLRTGCYFGLITCDTPPGVWPEGVPSVIAPVPPSRTSGVTTNSPGFTSSVLSFTSSSPPVTGSSSFVTTTTTLAS
STSTSTSTSLPSFTSTLVSVSTPVSASSTMSLIPSPSSSIIPSATPSASVIANGNVAGNILVIAKDTAAANVATSGLNGY
GIPFTILLVPQSGVILPELNGTSGGNFGGIVVASEVSYDYGAQGFQSALTIDQWNQLYAYQLEYSVRMVQYDVYPGPNYG
ASAVGGGCCDSGVEQLVSFSDVSDFKEAGLKTGAGVSTTGLWHYPASVNDTATTKEIARFAANGNYGSETTAAVINNFNG
RQQMAFFLSFDTTWSATSNYLQHAWINWLTRGLYAGHRRVNLNTQIDDMFLETDIYYPNGTTFRITTADMDGISSWLPTI
NGKMNAGSSYFVEVGHNGNGVIEAAAGKDADACNGGGIEHDSPADTPLEFKKPLGTGTDLWPKDLTEYNWTTECTKLDDL
FVWWTTPANRDKYGHISHTFTHEEQNNATYNDVKREISFNQAWLRQSGFYDAKYFTSNGIIPPAITGLHNGDALRAWYEN
GITNCVGDNTRTPLLNQQNSMWPYFTTSASDGFDGMQVNPRWATRIYYNCDTPACTVQEWIDTSAGSGDFSNLLATEKAD
TMRHLFGLHRDPYMFHQANLRNVGVDPVEINGETGQWSINQAWVETMVQEFVRLVDWPIVTITHQEMSANFLDRYNRDQC
NYSLQYTIGNKQITGVTLSAKDNTCNAPIPVSFPVAPTDTKGFTTEQYGSDPLTVWVQLSGSPVTFSLSTPIPL

BASE SEQUENCE OF NUCLEIC ACID MOLECULE OF Aspergillus oryzae agd3 (Genbank accession No. AOR_1_2582174)

ATGGTCCTACCGTGGTTGCTGAGAACTGGTTGTTACTTCGGACTTATAACTTGCGACACTCCCCCAGGTGTTTGGCCTGA
AGGTGTCCCAAGTGTGATCGCTCCTGTGCCTCCCTCACGCACATCTGGAGTCACGACCAACTCTCCCGGCTTTACTTCGT
CGGTCCTGTCGTTCACTTCTTCTTCCCCTCCTGTCACGGGGTCATCGTCTTTCGTTACGACTACTACTACTCTCGCTTCC
TCCACTTCCACTTCTACTTCAACCTCTCTACCTTCGTTTACTAGCACACTCGTTTCTGTCAGCACTCCCGTGAGTGCCTC
CAGCACAATGTCTCTAATTCCTTCTCCTTCGTCGAGTATCATTCCTTCCGCAACACCTTCCGCTTCTGTCATTGCCAATG
GTAATGTCGCGGGTAACATCTTGGTGATTGCGAAGGACACCGCTGCTGCTAATGTGGCTACCTCGGGCCTCAATGGCTAT
GGTATTCCTTTTACTACCTTGCTCGTTCCGCAGTCTGGTGTTACTCTGCCAGAGCTGAATGGCACCTCCGGAGGAAACTT
TGGCGGTATCGTGGTTGCGAGCGAGGTCAGCTACGACTATGGTGCCCAAGGCTTCCAGAGCGCTCTGACTACCGACCAAT
GGAATCAACTCTACGCCTATCAGCTCGAGTACAGTGTACGCATGGTGCAGTACGACGTGTACCCGGGACCCAACTACGGT
GCCTCTGCCGTGGGTGGCGGATGCTGTGACTCCGGCGTGGAGCAGCTTGTTTCTTTCTCAGACGTCAGTGACTTCAAGGA
AGCCGGCCTGAAGACTGGTGCCGGTGTCAGTACGACAGGCCTCTGGCACTACCCAGCCTCAGTTAATGATACTGCTACCA
CCAAGGAAATTGCTCGTTTCGCCGCCAACGGCAACTACGGCAGCGAGACCACTGCTGCAGTCATCAACAACTTCAATGGC
AGACAGCAAATGGCTTTCTTCTTGTCTTTTGACACTACCTGGAGTGCAACTTCCAACTACTTGCAGCACGCATGGATCAA
CTGGCTCACTCGGGGTCTCTACGCTGGCCACCGTCGCGTCAACCTGAACACCCAGATTGATGATATGTTCCTCGAAACTG
ATATCTACTACCCCAATGGAACGACCTTCCGTATTACCACCGCTGATATGGATGGTATCTCGAGCTGGCTCCCGACCATC
AACGGCAAGATGAACGCCGGTAGCTCATACTTTGTTGAGGTCGGACACAACGGTAACGGTGTCATCGAAGCCGCTGCCGG
CAAGGATGCCGATGCCTGCAACGGAGGTGGCATTGAACACGACTCGCCCGCTGATACTCCTCTGGAGTTCAAGAAGCCTC
TGGGCACCGGTACTGACCTTTGGCCCAAGGACCTGACCGAGTACAACTGGACTACTGAGTGCACCAAGTTGGACGATCTT
TTCGTCTGGTGGACCACCCCGGCTAACCGCGACAAGTATGGTCACATCTCTCACACTTTCACTCATGAAGAGCAGAACAA
TGCCACCTACAACGACGTGAAGAGGGAGATCTCTTTCAACCAGGCTTGGTTGAGACAGAGTGGTTTCTATGATGCCAAGT
ATTTCACATCCAACGGTATCATCCCTCCCGCCATTACTGGGTTGCACAACGGCGATGCCTTGCGGGCCTGGTACGAAAAC
GGCATCACCAACTGTGTTGGTGATAACACTCGCACACCGCTCCTCAACCAGCAGAACAGTATGTGGCCTTACTTCACTAC
CTCCGCATCGGATGGATTCGATGGTATGCAGGTGAACCCCCGTTGGGCCCTCGGCATCTACTACAACTGCGATACCCCTG
CCTGCACCGTTCAGGAATGGATTGACACCTCCGCCGGCAGCGGTGACTTCAGCAACCTGCTCGCGACCGAGAAGGCCGAC
ACCATGCGCCATCTCTTCGGTCTTCATCGGCGACCCTTACATGTTCCACCAGGCCAATCTTCGCAATGTCGGCGTTGACCC
GGTTGAGATCAACGGTGAGACTGGCCAATGGTCCATCATGCAGGCGTGGGTGGAAACCATGGTGCAGGAATTCGTCGGTC
TGGTAGACTGGCCCATCGTTACCATCACCCACCAGGAGGTAAGTCATGGAGATCTTAGAAACTCCTCCTAACACCGCGCA
ATTGCTAATTAATCACCCCAGATGTCCGCCAACTTCCTCGACCGCTACAACCGTGATCAGTGCAACTACTCGCTGCAGTA
CACCATCGGCAACAAGCAGATTACTGGGGTGACTCTGAGCGCCAAGGACAACACTTGCAATGCGCCCATCCCCGTCAGCT
TCCCTGTCGCCCCCACCGACACCAAGGGCTTCACCACCGAACAGTACGGCAGTGACCCACTCACCGTCTGGGTGCAGCTG
TCGGGCTCCCCCGTCACTTTCTCCCTCTCGACCCCTATTCCCTTGTAAATGGATTGAACGATATTGAATTATGGAAGGGC
TTTGAAGGATTCCTGGACCATAATATCTAATGTTATTAATGGGTTTCGTGTAGCGATTTCGAATAGGGGAAGAGATGAAT
GAAATGTTAGGTACATACATACATAACTACATTGCATACATACTACATA

Fig. 40
PUTATIVE AMINO ACID SEQUENCE OF Aspergillus oryzae Gtb3 (Genbank accession No. AOR_1_2580174)

MAEILHVSALGWDKMKDHWWQFVFIAILIACVATGSLWLLYSGTKRLRNYIKTRPRSEKVPLNVSQRLVTLSNKLLSVPN
IQRRKPSSFGVYLGSFSSPPDRDQLRLLNEWDLLIVDPFQSGTAQAIRYVEGKQLLGRVDLDRILSKDESTLSAIEKIEN
LLTGTFDSANFSGMVLANWEGKFPTPVFTKLVEVIDELGLAVYLETAPPDFLKDHNSMQNPAISGIVIQNASILPEGQKR
DYFQLVKMQPTIKAFVSEACVRDFVVMAWETIDDNAALSNAVVQRSLQWCNFYSAIPWIGQKSALTNAALNVKISEPLSS
FGWLKDAEIIKAHDRWRSNLHLKDVASDTNAWNTLLPFFPTLEELLTSSEYGQPESNELTTKLRDPPEWVAQVKSLGSPL
SISMAGIEYNSLGCFPLGSEATALAFAEVLQSQLRLKSLGLLHPVPASKIQSIGLLLKKFHESYLLPNATSSDPYVIPNA
TSDQLATTIKELSNLATNGSLQVNLGLDSGLRKSVDVRFWAVYQMDSDGFEVFASKKAQGLAGTVLHTFLSAKGYPRHVC
FEVETALAKWSQDLVKDTGLPRRLVEDIDMLSPEERLLLFQHLSLTDSYSELSDTICAYIRRLLIDAPSLAQLKELNTVS
YLEGSASPEILVNTRIKWYREQGCQHPSPSKCLALFYQTDAAFTQILREHREGDLALISKGFCQLLQNDHIDTYTDIMAL
ALFCAARKGAIDEIYTEVTDRNPLFNNQSDQAAAFSESFALGSRCEVYFDVQPSAFGKLLSDRFRREYNDEKLPDWINGA
PEMATSYAGAQIDVNPDHKVKSMPGYQRFTFLGVFAFPALIDIILLTIIGRGLYLSAFMTHDELQSATIALMISLLLSGA
IGTMIACGGPYYLISMAFAASNMFVLIRLIAGVAFTIAAGLIGFIVISGVKSPQAGIIFYLYLVALTIYLTTFATLASFS
YPGTGFLSGRKVIFSCIPILFVSPIITTWSGHDSAIYLAVLYVFIGFLLLGLRSVASKWVTWYQNIRRTDDTEIRKWYIA
TYGNNDEKVFGNMSDPAVLKMSRDALYKDVLAEKSRSFFSKPTTDTLVRELARDWDSTNFLLDWYCRYADVPRPIPFSSS
WNIQTKVGLDVLRNSQKGIRLHNAFIHWRQSSKEIGCGILYFIIALLDKWVELLSGGQLVGLSTSLSDANRMAVGFGLAY
YLIGAVLIDTKAQELHDLVGGHSAVAVGSAKEIRPSQKRDVRFKRKVYWKTFFKFLMWLVWSLAIATALIWTFQAPVQAM
IMFFAYVLSYTGLLWYQYTKIFTGPHALIPLMTGVVVGLPVGIALKVCLGNNFLYSQVIGLGAATWTVAILSLFTAKMGM
PKKVDSPVELGKTFHAYTAPWADPEWSQQELQTFFEGVSVVPADARLKLVPGSHPGVEVKTILLSRKIEPRIEEAFPESE
KLISMALGAWETGEISLELVPLGSLGPNIQALSCSMSGHLQIAICVGRGLDERIDVSANCQVIAETLLHAVAESMMRMPH
EYAVLSESLVTAGVTETTARQLREEPDTPLVVRWSKKELLRQLCLGFEVDSHWEKLPENVRNMLLDRCLGRPCLLSEGSQ
QWLQTSLCRFDTSDLNVHVARCNLGAATAVSILDYANYGTGEAGAIKDPEIPIYIPEIPKKLPMAMSIIQKPLSYVYHSI
GSGVKFFIAALLADSEFQREFDHVMSERHTLIRVPLVFLLNMVWLYFKTVQDIGLSFFLFHGRSNVKRLWNETKGITVSI
KKSRFVVQSLEGTFAAFRHNEPDGGFKVYYYSGEHKTEPEGMKLLKYVSTYSKDMLLLIRQEFKDGKVLNEYHYDYRAPT
KKSFTLSKAWATRIPLGRRCVRGQNNLQSVQYNRKGLIEAGSYMKDGNLIRFKYHYRKNPRFGDELLRAEFSLTHITCTV
SWCAPPLRHPEKVERWIPHSKVTEATFVQGADVYEARWLYDHKFHPTIFTTLNGQKVQTPPMIENDFIGVLAKPKQTSFA
NDNPLLYCDSLSSNTVTRFLGLTTKRFPVSTSRARSLLWKSWKDRVDFDAIMVRWMDERLLRREKTLAPYWRARNRGDLA
AAKKYLELRADAITASADLDDNISSWTPLAVKISDLFNFGPGGDAVVHTRSKDFGSDTDKSMHVMAADNGTWPNEGGGVS
ACRRDMINSLRTVKWHMICESANDFGIPKHQTEQNVLSLKVVPLWGLDFLTPTHGLFRNKLDSEVDNVTSASDMDIKLNF
IPILTALVKGARATHLSKADIHQATRALVNLNTYFQDSRHWTQIWNSDIVKESWRDLWLTQEMPNTVPSSQWFRTELPTL
TSLDTALELWYRYLFIFSIPIPEKIPSVFQASHHSVSASYGVVCKMKRNCTLQIWDHAISWRETNLCLSSALCKLSPFVR
NALLGLMRITSALTLHHADIILPCADFFNPGWEVEIGTCQGTIEHRNVFRRKVDPVVNGITDMQKFAPVKEIKSERPTVT
MLSHVWYAKDIKIALLAADIIINQWKFDDYHLDIYGAIDKAPTYSTECQEIIASKGLRGKVTLRGTADPMKVLENTWLFL
NSSLSEGLPLALGEAALTGAPVVCTDVGASLRVLSDPDDFSRYSAVVAPNDAHALAKAQITMLGLLGEWSKYTDDTEPAP
VLTSSPTPEDVAKITRRMYEKSDYRRKLGMMTRDIVQKSFSGDRYLREHEQMLWIGKSAKIMANRVGGAITEPTDIATAM
RQTLPIEEEVITIPRSAVHSWRSSAASGMSTVYSEVSNFPMLNGYHRPSSIRSGISGMSTDTESFLPLPSNASLPVFAPR
QTLGYPSTPDGRLSPSGRLSPLPNPRNSGRRSMSTAGREQLRGLGREELNPYRNSDVSTIMRDEFLKSSIYKNIEGSNST
PNMI

Fig. 41
BASE SEQUENCE OF NUCLEIC ACID MOLECULE OF Aspergillus oryzae gtb3(Genbank accession No. AOR_1_2580174)

```
CGGACCTGTGAGGTTGGCCTGCAATATCTAATCAGGATGGCGGAAATCCTCCACGTCTCAGCCCTCGGCTGGGATAAAAT
GAAAGATCATTGGTGGCAGTTTGTAAGTAGTGATTGCATATACGTTTCAGATATCACTGACTAATGCTATGCTAGGTGTT
CATCGCTATCTTAATAGCGTGTGTAGCTACAGGATCCTTGTGGCTTCTGTACTCTGGGACGAAGAGACTGCGCAACTACA
TTAAGGTAGGGCTTCTTTGATATGCTTGTGAATGTATATCTGATCTGTCACTCACCTGATTCAAATCATAGACAAGGCCA
CGTTCAGAGAAAGTGCCGCTCAATGTATCTCAACGGTTGGTTACTCTTTCCAACAAGTTGCTCAGTGTGCCAAACATTCA
AAGACGCAAGCCGTCTTCTTTTGGCGTCTATCTGGGTTCATTCAGTTCCCCGCCAGATCGGGATCAGCTTCGGCTTCTGA
ATGAATGGGACCTGTTGATAGTTGACCCTTTTCAGTCGGGCACGGCCCAAGCAATCCGTTATGTGGAGGGTAAGCAGTTA
TTGGGAAGAGTTGACCTTGATCGTATCCTCTCAAAGGACGAGTCGACATTGTCAGCAATTGAAAAGATTGAAAACCTTCT
CACCGGCACATTCGATAGTGCTAACTTCAGCGGCATGGTACTGGCCAACTGGGAAGGAAAGTTTCCCACCCCGGTTTTCA
CTAAGCTTGTCGAGGTGATCGATGAGTTGGGTTTGGCAGTGTACCTGGAGACGGCACCCCCGGACTTTCTAAAGGACCAC
AACTCCATGCAGAACCCTGCAATTTCCGGAATCGTTATTCAAAATGCCAGTATACTGCCAGAAGGCCAGAAGCGCGACTA
TTTTCAACTCGTGAAGATGCAACCCACCATCAAGGCGTTCGTCTCCGAAGCTTGTGTGAGGGATTTCGTGGTGATGGCGT
GGGAGACAATCGATGACAATGCCGCGTTATCAAATGCTGTTGTCCAAAGATCTCTTCAGTGGTGTAACTTTTATAGTGCG
ATCCCGTGGATAGGCCAGAAGTCGGCTCTCACAAATGCTGCCCTTAATGTCAAGATCTCAGAGCCTCTCTCCTCTTTTGG
ATGGCTGAAAGATGCCGAAATCATCAAAGCTCACGATCGCTGGCGCTCAAATTTACATCTCAAGGATGTTGCATCCGACA
CGAACGCTTGGAATACATTGTTGCCGTTTTTCCCCACCCTGGAAGAATTGCTTACCTCGTCGGAATATGGTCAGCCTGAG
AGCAACGAGTTGACGACAAAACTCCGTGATCCACCGGAGTGGGTAGCACAGGTAAAATCTCTAGGGAGTCCACTTTCCAT
ATCAATGGCCGGCATTGAATATAACTCTCTTGGTTGCTTCCCGCTTGGATCTGAGGCGACAGCACTTGCCTTTGCTGAAG
TCCTTCAGTCTCAATTGCGCCTTAAATCACTGGGCTTGCTCCACCCGGTTCCTGCTTCCAAGATTCAGAGGCATCGGTCTG
CTCCTCAAGAAATTTCACGAATCTTATTTGCTTCCCAACGCAACCAGCTCAGATCCTTACGTTATTCCAAACGCAACCTC
GGACCAACTGGCGACTACGATCAAGGAACTGTCGAATCTGGCAACTAACGGCTCATTGCAGGTCAACCTTGGATTGGACT
CAGGACTTCGTAAGAGCGTCGACGTGCGCTTTTGGGCAGTTTATCAGATGGACTCAGATGGATTTGAAGTTTTTGCTTCG
AAAAAGGCCCAAGGTTTAGCAGGAACTGTACTGCATACATTCTTGTCTGCAAAAGGTTACCCCCGCCACGTTTGTTTTGA
GGTAGAAACCGCTTTAGCCAAATGGTCCCAGGACCTCGTCAAGGATACAGGGCTTCCTCGCCGACTCGTCGAAGACATCG
ACATGCTGAGCCCAGAAGAGCGACTGCTTCTATTTCAGCATCTCTCCTTGACCGACTCATACAGTGAGCTCTCCGATACT
ATCTGTGCTTACATTCGGAGACTGCTTATCGATGCACCTTCACTCGCTCAGCTGAAGGAGCTTAACACGGTCTCATATCT
TGAAGGCTCGGCTTCTCCCGAAATTTTGGTTAATACCCGCATCAAATGGTACCGAGAACAGGGATGCCAACATCCGTCAC
CATCCAAATGTCTCGCATTATTCTACCAGACGGATGCTGCTTTTACTCAGATCCTAAGGGAGCATCGCGAGGGAGACCTT
GCTTTGATATCAAAGGGCTTCTGCCAGCTGCTTCAAAATGATCACATCGATACGTATACTGATATCATGGCATTGGCACT
TTTCTGCGCTGCGAGGAAAGGAGCAATCGATGAGATTTATACTGAAGTGACCGATCGTAACCCGTTGTTCAACAATCAGT
CAGACCAAGCGGCTGCTTTCTCAGAATCGTTTGCTTTAGGGTCACGTTGTGAGGTCTACTTTGATGTTCAGCCTAGCGCT
TTTGGAAAGCTGCTCTCGGATCGTTTCAGAAGGGGAGTACAACGATGAAAAGCTCCCCGATTGGATCAATGGCGCGCCTGA
GATGGCCACATCTTATGCGGGTGCCCAAATTGACGTTAACCCGGATCACAAGGTTAAATCGATGCCTGGTTACCAGCGAT
TTACTTTCCTCGGTGTTTTCGCATTCCCGGCATTGATCGACATCATTCTGCTCACAATTATCGGCCGTGGTCTCTACCTT
TCAGCCTTCATGACCCATGACGAGCTGCAAAGTGCCACCATCGCTTTGATGATCTCTCTTCTCCTATCTGGTGCAATCGG
TACGATGATTGCCTGTGGAGGACCCTACTATCTCATTTCGATGGCTTTCGCAGCTTCAAACATGTTTGTCCTTATCCGAC
TAATTGCTGGTGTTGCGTTTACAATTGCTGCTGGTTTAATCGGATTCATCGTTATCTCTGGCGTGAAAAGCCCACAGGCT
GGAATTATCTTCTATCTGTACCTAGTCGCCTTGACCATTTACCTGACGACCTTCGCTACCCTCGCTAGCTTTAGTTACCC
TGGAACCGGTTTCTTGTCCGGACGCAAAGTGATCTTCAGCTGCATCCCCATTCTTTTCGTCTCACCTATCATCACTACTT
GGAGCGGCCACGATTCAGCTATTTACCTCGCTGTGCTATACGTGTTCATCGGGTTTTTGCTTCTCGGCTTGCGATCAGTT
GCCTCCAAATGGGTGACCTGGTATCAAAACATTAGAAGGACGGACGATACGGAAATTCGGAAATGGTACATTGCCACGTA
CGGTAATAATGACGAGAAGGTTTTTGGAAACATGAGTGACCCGGCTGTCTTGAAAAATGTCAAGAGATGCTCTCTATAAGG
ATGTCTTGGCTGAGAAGTCCCGGAGCTTCTTCTCTAAGCCCACAACTGATACGCTGGTCCGCGAGCTTGCCAGGGACTGG
GATTCGACAAATTTCCTCCTCGACTGGTACTGTCGTTATGCTGATGTGCCTCGGCCGATTCCGTTCAGTTCTTCTTGGAA
TATCCAGACCAAGGTCGGACTAGACGTTCTTCGGAATTCCCAGAAAGGAATCCGGTTGCATAATGCCTTCATCCATTGGC
GCCAATCGAGCAAAGAAATAGGCTGTGGAATCCTGTACTTTATCATAGCCCTCTTGGACAAATGGGTTGAGTTATTGAGT
GGTGGACAACTCGTTGGTCTCTCAACCTCCCTTTCTGATGCCAATCGAATGGCAGTCGGATTTGGACTGGCTTACTACCT
CATTGGGGCCGTTCTCATCGATACCAAAGCCCAGGAACTCCATGATCTTGTGGGCCAGCATTCGGCTGTTGCTGTGGGAT
```

Fig. 42

```
CGGCCAAGGAGATACGTCCGTCCCAAAAGCGAGACGTGAGATTCAAGAGAAAAGTCTACTGGAAGACCTTTTTCAAATTC
CTCATGTGGCTTGTGTGGAGCTTGGCTATTGCAACGGCTTTGATCTGGACTTTCCAAGCACCAGTGCAAGCGATGATCAT
GTTTTTCGCTTATGTATTGTCCTATACCGGCCTGCTTTGGTACCAATATACAAAGATCTTCACCGGCCCGCACGCGCCTCA
TACCGCTGATGACTGGTGTTGTCGTCGGATTGCCTGTCGGTATCGCCCTCAAAGTATGCCTTGGCAATAACTTCTTGTAC
TCCCAGGTGATTGGTCTAGGAGCAGCTACATGGACAGTGGCTATCCTCTCCCTTTTCACCGGCCAAGATGGGCATGCCCAA
GAAAGTTGACTCACCGTGTGGAGCTTGGGAAGACATTCCACGCATATACCGCTCCATGGGCGGATCCTGAGTGGTCACAAC
AAGAGTTACAGACATTCTTTGAAGGAGTCTCAGTCGTCCCTGCCGATGCACGGTTGAAACTTGTGCCCGGCTCGCATCCT
GGTGTTGAAGTTAAAACTATTCTACTTTCGCGGAAGATAGAACCAAGAATGAAGAGGCCTTCCCGGAGTCGGAAAAGCT
CATCAGTATGGCCCTGGGTGCCTGGGAAACGGGCGAAATATCCCTTGAACTTGTGCCATTGGGCTCGCTTGGCCCCAACA
TCCAGGCGTTGAGCTGCAGTATGTCTGGTCATCTGCAGATAGCCATCTGCGTTGGACGAGGACTAGATGAGCGGATTGAT
GTCAGCGCTAACTGCCAGGTCATTGCCGAGACTCTACTCCACGCGGTCGCCGAATCAATGATGCGAATGCCCCACGAGTA
TGCCGTGCTTTCTGAATCGCTTGTTACTGCTGGTGTGACTGAAACGACCGCCCGACAACTTCGGGAGGAAACCTGACACTC
CACTCGTCGTACGCTGGTCAAAGAAGGAGCTTCTGCGGCAACTGTGTCTTGGATTTGAGGTCGACTCTCATTGGGAAAAA
CTGCCTGAGAATGTTAGGAACATGTTGTTGGATCGTTGTCTTGGTAGGCCATGTCTACTATCCGAGGGCAGTCAACAATG
GCTTCAAACGAGTCGTTTGTCGGTTTGACACAAGCGACTTGAATGTGCACGTTGCTCGCTGCAACCTGGGAGCTGCCACTG
CTGTTAGTATCCTTGATTACGCGAATTACGGAACCGGTGAAGCAGGGGCCATCAAGGATCCGGAAATCCCGATATATATC
CCAGAAATCCCGAAGAAGCTTCCTATGGCCATGTCCATCATCCAGAAGCCGTTGAGCTATGTATATCACTCTATTGGCTC
TGGAGTCAAGTTCTTCATCGCTGCTTTACTTGCCGATTCCGAATTCCAGAGGGAATTTGATCATGTCATGAGTGAGCGCC
ACACATTAATTCGGGTACCGCTTGTGTTTTTGTTGAACATGGTTTGGTTGTATTTCAAAACGGTGCAAGATATTGGTTTG
TCGTTTTTCTTATTCCATGGCCGGTCCAACGTGAAGCGGCTGTGGAACGAAACCAAGGGCATTACCGTCAGCATCAAAAA
GAGTCGCTTTGTTGTGCAGAGCTTGGAAGGTACCTTCGCTGCTTTTAGGCATAACGAGCCCGATGGCGGCTTCAAGGTAT
ATTATTACTCGGGAGAGCACAAGACAGAGCCAGAGGGCATGAAGCTTCTCAAATATGTCAGCACATATTCAAAGGATATG
CTTCTGCTCATTCGCCAAGAGTTCAAGGACGGCAAGGTGCTCAACGAGTACCACTATGATTACCGCGCTCCAACAAAGAA
GAGCTTTACCCTATCCAAGGCGTGGGCGACCAGAATCCCCTTGGGTCGGCGTTGCGTACGCGGACAAAACAACTTGCAAA
GTGTTCAGTACAACCGCAAAGGTCTCATCGAAGCGGGCTCCTACATGAAGGATGGAAATCTTATTCGCTTCAAATATCAT
TACCGCAAGAACCCTCGCTTCGGTGATGAGCTGTTGCGCGCTGAGTTTTCGTTGACACATATCACTTGCACAGTTTCCTG
GTGCGCGCCTCCTCTTCGCCATCCGGAAAAGGTTGAGCGATGGATCCCTCATTCTAAGGTCACCGAAGCGACGTTTGTCC
AAGGAGCTGATGTCTACGAGGCTCGTTGGCTGTACGATCACAAGTTCCATCCCACGATTTTCACGACGCTTAATGGACAG
AAGGTGCAGACACCTCCGATGATCGAAAACGACTTCATAGGAGTGCTCGCCAAACCTAAACAAACCAGCTTTGCGAACGA
TAACCCTCTTTTATACTGTGACAGCCTCAGCTCGAACACTGTCACCCGTTTCCTGGGGTTGACAACTAAGCGCTTCCCTG
TATCCACTTCTCGTGCTCGTTCATTGCTATGGAAGTCTTGGAAAGACCGCGTAGATTTTGATGCAATTATGGTCCGTTGG
ATGGACGAGCGGCTCCTGCGAAGAGAAAAGACCCTGGCTCCCTACTGGCGTGCTCGTAATCGTGGTGATCTGGCAGCGGC
GAAGAAATATCTTGAACTCCGCGCGGACGCCATCACCGCCAGCGCTGATTTGGATGACAACATCTCCAGCTGGACCCCTC
TTGCGGTGAAGATTAGCGATCTTTTCAACTTCGGACCCGGAGGCGATGCGGTGGTCCACCACGATCGAAGGACTTCGGC
TCTGATACTGACAAGTCGATGCATGTCATGGCTGCTGATAATGGCACTTGGCCGAACGAAGGAGGTGGTGTCTCTGCCTG
TCGACGTGATATGATTAATTCGCTAAGGACAGTCAAGTGGCACATGATTTGCGAATCAGCAAATGACTTTGGTATTCCCA
AGCACCAGACGGAGCAAAATGTCCTTTCGTTGAAAGTGGTTCCTCTTTGGGGCTTGGACTTCCTCACTCCAACACATGGG
CTTTTCAGGAACAAACTCGGACTCGGAAGTTGATAATGTTACATCCGCCAGTGACATGGATATCAAGCTTAACTTCATCCC
AATTCTGACTGCTCTGGTGAAGGGAGCGCGTGCGACTCACCTTTCAAAGGCTGATATCCACCAGGCGACTCGGGGCTTTGG
TCAACTTGAACACATACTTCCAGGACTCGCGGCATTGGACTCAGATCTGGAACAGCGACATTGTCAAAGAAAGCTGGAGA
GACCTTTGGCTTACTCAAGAGATGCCTAATACCGTTCCATCATCCCAGTGGTTCCGCACCGAACTTCCAACCCTAACATC
ACTTGATACTGCCTTGGAACTTTGGTATCGATATCTCTTCATTTTCTCCATTCCAATTCCTGAGAAGATACCCAGCGTCT
TTCAAGCATCGCATCCACAGTGTTAGTGCGTCCTACGGGGTTGTATGCAAGATGAAGAGAAACTGCACCTTGCAGATTTGG
GACCCACGCCATTAGTTGGCGTGAAACGAACCTCTGCCTGTCGTCGGCCCTGTGCAAGCTTTCTCCATTCGTTCGCAATGC
TCTCTTAGGTTTAATGCGCATCACTTCGACTCTTACTTTGCACCATGCCGATATCATTCTTCCTTGCGCTGATTTCTTCA
ATCCAGGCTGGGAGGTTGAAATTGGTACCTGTCAAGGAACCATTGAACATCGCAATGTTTTCCGCAGGAAGGTCGACCCC
GTTGTCAATGGTATCACTGACATGCAAAAGTTCGGCCCCTGTGAAGGAGATCAAGTCTGAGCGCCCGACAGTCACCATGTT
GTCGCACGTGTGGTATGCCAAGGATATCAAGATAGCTCTGCTTGCCGCCGACATCATTATCAACCAGTGGAAGTTTGATG
ATTATCACCTGGATATTTATGGGGCCATCGACAAGGCGCCAACATACTCTACTGAATGTCAAGAAATCATCGCCTCCAAG
GGTCTCCGAGGCAAGGTTACTCTCCGTGGTACGGCAGATCCGATGAAGGTGCTCGAGAACACCTGGCTTTTCCTCAATTC
```

Fig. 43

```
GTCACTTTCCGAAGGTCTGCCCCTTAGCTTTAGGTGAAGCTGCTCTGACCGGTGCCCCCGTGGTTTGTACTGATGTCGGTG
CATCTCTTCGTGTTCTGAGCGACCCAGACGACTTCTCTCGTTACAGTGCCGTCGTCGCACCCAATGACGCTCACGCCCTC
GCAAAAGCGCAGATCACCATGCTTGGCCTTCTGGGAGAATGGAGCAAGTATACTGATGACACTGAGCCGGCACCTGTGCT
CACTTCATCTCCAACACCAGAGGATGTTGCCAAGATCACCCGCCGCATGTACGAGAAGAGCGATTATCGTCGCAAACTCG
GCATGATGACCCGCGATATCGTCCAGAAATCATTCAGCGGCGACCGATACCTCCGTGAGCACGAGCAAATGCTGTGGATC
GGCAAGTCTGCTAAGATTATGGCCAACCGAGTTGGAGGAGCCATCACCGAGCCCACAGACATTGCAACAGCCATGCGCCA
GACTCTCCCGATTGAAGAAGAAGTCATCACCATCCCTCGCAGCGCCGTGCACTCGTGGCGTTCGTCTGCTGCATCGGGCA
TGTCGACAGTATACAGTGAGGTTTCCAATTTCCCAATGCTCAATGGCTACCACCGCCCATCCTCTATTCGCTCAGGTATA
AGCGGTATGTCAACGGATACAGAGTCTTTCCTTCCTCTCCCCAGCAACGCCTCTCTCCCTGTCTTCGCTCCTCGTCAGAC
CCTGGGCTACCCCAGCACCCCTGACGGTCGTCTCTCACCTTCGGGGCGTCTCTCACCGCTACCAAACCCAAGGAACAGTG
GTCGACGATCCATGTCAACCGCTGGCCGCGAGCAGCTACGTGGTCTCGGACGCGAAGAATTGAACCCTTACCGCAATTCC
GACGTCAGTACCATCATGAGAGACGAATTTCTTAAATCAAGCATCTACAAGAACATAGAAGGCAGCAACAGCACCCCCAA
CATGATCTAAAACGAAAAAGGAAAAGAAACAGAAAAATCCCATCTAGTTCTCTTGTTTTTACACTTTTTTTTTTTTCTTT
TTTTTTTTGCATACTATGATTGATTCTTGGGTTATACTCCCGGCCCTGGCAATAATTGCTAATCTGTCATTGTCTATACC
AACCATATACCCCGAGATGATGAAGTGCTCGTTGTAAATACCTGCATCTTGCATATACTTTCCTTTTATTTTGCATCTAAC
TTCATCATTA
```

Fig. 44
PUTATIVE AMINO ACID SEQUENCE OF Aspergillus nidulans Uge3   (Genbank accession No. AN2951)

MDSPRRSDASSPAEPCSPVCVDTPATQSSVLFDGNLDDLLRNFPLRQYILVTGGLGFIGSHTTLELLKASYNVVVIDNLS
NSFQSVFDRIKHLAQKHHDERGTEMPALHLAAHDYRDTAALRQLLDQYQVDSRWGTPKSKISGVIHFAAYKAVEESIKNP
LKYYANNVSGLIDFASTLGKYGIKTFIFSSSATVYGTLATSGLPLKEELCAHKDEIYHDADGVAQTIRAGSTGITNPYGR
TKWMCEAILADLAASDPEWTIVALRYFNPIGCDESGLLGEDPKQTPTNLLPVVVKVMTGEYNELSMFGTDWETEDGTAVR
DFIHVTDLARGHIAALDAANERKLAENFRAFNLGTGRGHSVKEVVDAMESVSRKQIPVRAAPRRPGDVGSCVAVATRSQQ
ELRWKTEKSLTDACGSLCKFLEVSGVTL

BASE SEQUENCE OF NUCLEIC ACID MOLECULE OF Aspergillus nidulans uge3 (Genbank accession No. AN2951)

ATGGATAGTCCTCGACGATCAGATGCAAGCTCTCCTGCGGAGCCCTGCTCTCCGGTATGCGTGGACACACCAGCGACACA
GTCCTCTGTCCTGTTCGACGGCAATCTGGATGACTTGTTGCGGAACTTCCCTCTTCGTCAGTACATCCTGGTCACTGGCG
GGCTCGGGTTTATCGGAAGTCACACAACATTAGAGCTGCTGAAGGCCAGCTATAACGTGGTTGTGATCGACAATCTCAGC
AATTCTTTCCAAAGTGTCTTCGACCGCATCAAGCACTTGGCGCAGAAGCACCATGACGAGCGAGGAACTGAAATGCCAGC
TCTGCATCTGGCTGCTCACGACTACCGAGACACTGCCGCTCTCAGGCAGCTTCTCGACCAGTATCAGGTCGATTCTAGAT
GGGGCACTCCCAAGTCCAAAATTTCCGGCGTGATCCACTTTGCTGCGTATAAAGCAGTCGAGGAGAGCATAAAAAATCCG
TTGAAGTACTATGCAAACAACGTTAGTGGTCTCATTGACTTTGCCTCGACACTCGGAAAGTACGGCATCAAAACATTCAT
ATTTTCCTCATCGGCAACCGTTTATGGCACTTTAGCCACTTCTGGTCTTCCACTCAAGGAAGAGCTCTGCGCCCACAAGG
ATGAAATTTACCACGACGCAGATGGAGTCGCTCAAACCATCAGAGCAGGGTCTACGGGAATTACCAATCCCTATGGGCGC
ACCAAGTGGATGTGCGAAGCCATACTGGCGGATCTTGCAGCTTCTGATCCGGAGTGGACGATTGTTGCGCTCCGGTATTT
CAACCCAATCGGCTGCGACGAGTCGGGATTGCTCGGTGAGGATCCGAAACAGACCCCTACGAATCTTTTGCCGGTGGTCG
TAAAGGTCATGACCGGAGAGTACAATGAACTCTCAATGTTCGGCACTGACTGGGAGACGGAAGATGGCACCGCCGTACGT
GACTTCATCCACGTAACCGACTTAGCCCGAGGGCATATAGCTGCTCTTGACGCTGCCAACGAAAGAAAGTTAGCTGAGAA
CTTCCGCGCCTTCAACTTGGGAACTGGGCGCGGACACTCAGTCAAGGAGGTAGTGGACGCTATGGAAAGCGTGTCGCGCA
AACAAATCCCTGTTAGAGCAGCCCCTCGTCGCCCTGGGGATGTTGGATCCTGCGTTGCCGTTGCTACCAGATCGCAGCAG
GAGCTCCGATGGAAGACTGAAAAATCACTTACGGACGCATGTGGAAGTCTGTGCAAGTTCTTGGAAGTTAGCGGTGTTAC
TTTATGA

Fig. 45
PUTATIVE AMINO ACID SEQUENCE OF Aspergillus nidulans Sph3  (Genbank accession No. AN2952)

MAVLIFVAILAIVLPTSIIVTRRKNNNMGPKAKVFVPLYVYPAPGAWDPLVNVITAHPDVNFTVVVNPGSGPGPNPLPDR
NYTQEIPRLTAHDNVRVLGYVATTYAKRNISSVRNDIETYAAWPTISANPKLAVRGIFFDETPQQYNASDLAYLEELTSV
VKNTPGLGPDHFVFHNPGVVPDPRYLSTADSTVVFEATYDTFQDRDGARLFETIPNSNRSQLCAVVHSVPDSVEGSELRK
FVKQARRVADEIFVTHLSTNYYASFGDKWDDFVRLMAQ

BASE SEQUENCE OF NUCLEIC ACID MOLECULE OF Aspergillus nidulans sph3 (Genbank accession No. AN2952)

ATGGCCGTCCTCATATTTGTCGCTATTCTTGCAATCGTTCTCCCGACATCAATTATAGTAACCCGACGCAAGAATAATAA
TATGGGCCCGAAAGCAAAGGTCTTTGTCCCTCTCTATGTGTACCCTGCTCCCGGTGCGTGGGATCCCCTAGTGAATGTGT
AAGTTTCCTTTGACCTGGGTGCGTTTTTATTTTGCCCCTCGCGTTTTTGCGAACGAACCCGAACCCCTGTAGGTCAGACA
GGTTGACCTAGATTCTGGAATCATGCGAACGCCATCAGCCGCCTGCAGAGGCACCGGCGTGGGACAGAAGGCGCCTTTGT
TTTTTCGGGGGCTGCAGCTAAACGCCGCTGTAGGATCACGGCACACCCCGATGTCAACTTCACGGTCGTGGTAAACCCTG
GCAGCGGGCCGGGTCCGAATCCCCTGCCTGATAGAAATTATACGCAGGAAATTCCTCGGTTGACGGCGCATGACAATGTG
CGCGTTCTCGGCTATGTCGCCACTACATACGCGAAGCGCAACATTTCGTCGGTGCGCAATGACATTGAGACCTACGCCGC
CTGGCCTACAATCAGCGCTAACCCCAAGCTTGCCGTTCGGGGAATATTCTTCGACGAAACACCGCAGCAGTACAATGCCA
GCGATCTGGCGTACCTAGAGGAGCTCACCTCCGTGGTGAAAAACACCCCTGGGCTCGGGCCCGACCATTTCGTAAGTTTG
ACGCTGTTTGTGATGAGCACCACGCGGATCTGCCTAATTCCGAGTGAGCCTCTTGTTGGGGCGATATCTCATATCCATCT
CCAACATCTACAATCTATTTTCCCTTGGCAGTGTGGTTGGATGTCTTAGTCTGTGACTTGTTCTAGCCTTGGAATCGGAC
CGATCTCTGTCATTCAACTACCGGTGCCGCGGTGTGGCCGGTAGATTGGGTACTAGCCATGCTAACTGGCGAATGCAATA
GGTTTTCCACAACCCTGGAGTTGTCCCAGACCCTCGCTACCTGTCGACGGCTGACTCGACTGTGGTGTTTGAGGCAACGT
ATGACACCTTCCAGGATCGCGATGGGGCCAGGCTGTTCGAGACAATTCCCAACAGCAACCGTAGCCAGCTCTGCGCGGTG
GTCCACTCGGTGCCGGACAGCGTGGAAGGGTCAGAGCTGCGAAAATTTGTCAAGCAGGCGCGGCGAGTCGCCGACGAGAT
TTTTGTTACCCATCTCAGCACGAATTACTACGCCAGCTTCGGAGACAAGTGGGACGACTTTGTTCGTCTGATGGCTCAAT
AG

Fig. 46
PUTATIVE AMINO ACID SEQUENCE OF Aspergillus nidulans Ega3    (Genbank accession No. AN2953)

METLKAPSTGWKSWTAKKKALLISSILIFIIALAVGLGVGLGLGLNKGSDNDNESGGNNTTPTTPNNTAIWQPAVGTSWQ
IVLRYALNDTSYDVDVYDIDLFDNKKAIIDELHSDGRKVICYFSAGTYEDWRDDADKFPEDDIGDNLDEWEGESWVDIRS
SKIRDIMLDRLDIAVQKGCDGVDPDNVDGYDNQNGLDLTQDDTVDYMNFLADEAHSRNLSIGLKNAGAVIPRVISRMQWS
VNEQCAQYDECDTYAAFVRRGKPVFHIEYPKGDDTNNEVQVTGQKKATACDFDDSNEFSTLIKNMDLDNWLQESGAYLPI
QVPPQTPQVRTQCHGQTTLIRAPTTGPTLHSQSSSPLLSRERQIRRPRYLLPQPT

BASE SEQUENCE OF NUCLEIC ACID MOLECULE OF Aspergillus nidulans ega3  (Genbank accession No. AN2953)

ATGGAAACCCTCAAGGCTCCCAGCACGGGCTGGAAATCCTGGACGGCCAAGAAGAAAGCTCTCCTAATCTCGTCGATTCT
CATCTTCATAATCGCCCTCGCTGTTGGTCTCGGCGTCGGTCTTGGCCTCGGCCTCAACAAGGGGAGCGATAATGACAATG
AGAGCGGCGGTAACAACACCACCCCGACCACCCCCAACAACACCGCCATTTGGCAGCCTGCCGTCGGCACCTCCTGGCAG
ATCGTGCTGCGCTATGCCCTGAATGATACCTCATATGACGTTGATGTATACGACATCGACCTCTTCGATAACAAGAAGGC
GATCATCGACGAGCTCCACTCCGACGGCCGCAAGGTGATCTGCTATTTCTCAGCAGGCACGTACGAGGACTGGCGCGACG
ATGCAGACAAGTTCCCCGAAGACGATATCGGCGATAACCTTGATGAATGGGAAGGCGAGAGCTGGGTTGACATCCGCTCG
TCCAAAATCCGCGACATCATGCTCGACCGGCTCGATATCGCCGTGCAAAAAGGCTGCGACGGAGTCGATCCAGACAACGT
TGACGGGTACGACAACCAGAACGGGCTTGACCTCACTCAGGATGATACGGTTGACTATATGAATTTCCTGGCGGATGAGG
CGCACTCACGCAATTTGTCGATCGGACTCAAGAACGCGGGCGCCGTGATCCCGCGCGTGATTAGCAGGATGCAGTGGAGC
GTCAACGAGCAGTGCGCGCAGTATGACGAGTGCGATACATATGCGGCATTTGTCCGGCGCGGTAAGCCGGTCTTTCATAT
TGAGTATCCGAAGGGGGATGACACGAATAATGAGGTCCAGGTTACGGGGCAGAAGAAGGCGACGGCCTGTGACTTTGACG
ACTCGAATGAGTTCTCAACCTTGATCAAGAACATGGACTTGGATAACTGGCTGCAGGAATGTTAGCTCTTACTGTCTACT
CTAAGGTTATGTTGAGAACGAGCAGGGGTTCTGTTGATCTTGTATCTAGATACTAGTGTAATATTCATACCCGATATTGT
ACTTCATTACTTTGTAACCGGGCTCGGCCATCATCAGAAACCCTTCAATCGCCAACGTCTTACTGGAAACTCAGTTCCTA
CCGTATACTATAGCCGGAGCCTACCTTCCCATTCAAGTTCCACCACAGACCCGCAAGTTCGCACGCAATGTCACGGTCA
GACCACACTCATTAGGGCCCCAACGACAGGCCCTACCCTTCATTCTCAGTCTTCGTCACCCCTTTTGTCAAGAGAACGAC
AAATACGCAGACCTCGCTATCTCCTGCCCCAGCCGACGTAG

Fig. 47

PUTATIVE AMINO ACID SEQUENCE OF Aspergillus nidulans Agd3 (Genbank accession No. AN2954)

```
MVAPTLVLQIGCFFGIFTCDTPRGVWPEGRPTVLSPWPPSPSSTSSTTSVPPAASSASTISVPTVTGPTEPTVTVTATSS
ASTTLTTLTTLPSPTDSATATSASTSADSTTISSTSSASDPAGSSTLVPTSEPSASEPSTSEPSSSTGTPGTSTSDPDPT
SATEPSSTSTSTPEPSGTVTSSTSTSSPSTSPPSTSSTSSTSPSSTLTSTSSPSTSSTLTPSASPTPSTTVTPSPSMSVT
STSVAPSATGSLANNILVIARDSTQASVASSGLNGYGIPFTTLLVPQAGVELPALNSSSGGNFGGIVVAGEVSYDYGNDN
WRSALTDDQWNQLYAYQLAYGVRMVQYDVFPGPNFGASSIGNGGCCADGVEQLVYFTDTSDFPTAGLKTGSSAGVSTSGL
WHYTASVTDTNTTKAIASFASGGGVDGESVAAVINNFDGRQQMAFFIGFDTVWSQTSNYLQHAWITWITRGLHAGYRRVN
LNTQIDDMFLETDIYQPSGTIFRITTDDMDGITNWLPSIRAKLNAGSTYFVEIGHNGNGNIEAGTTAAGESTCSGGAIEY
DSPPDTALEFVKPIGTGTDVWPTSPTNFTWTTTCMNADSLLIWFQNHLDDYAYISHTFTHLEQNNATYSDIYKEISFNQV
WLERAGFSAASKFTSNGIIPPAITGLHNGDALRAWWDNGITNCVGDNTRPVLLNSENEMWPYFTTEAADGFAGMQVNPRF
ATRIYYNCDTPACTTQEWIDTSAGAGDFNDLLDTERAEVLRHLFGLHRDPYMFHQANLRNVGIDPITVGSETGQFSIFQA
WVETIVAEFTRLVDWPIVTITHQENSAEFLARYTRDHCDYGLNYILDNGAITGVTVTANGNTCDANIPVTFPTAPTDTLG
FATEQLGSDPFTVWAQLSGSPVTFSLATPIAL
```

BASE SEQUENCE OF NUCLEIC ACID MOLECULE OF Aspergillus nidulans agd3 (Genbank accession No. AN2954)

```
ATGGTCGCTCCCACGCTGGTGCTGCAGATCGGCTGTTTCTTTGGGATATTTACCTGCGACACGCCCCGGGGAGTCTGGCC
TGAAGGACGCCCGACTGTTCTTTCCCCGTGGCCTCCCAGTCCCAGCTCGACGAGCTCAACTACTTCGGTGCCCCCGGCTG
CTTCGTCTGCATCTACGATCAGTGTCCCGACAGTCACCGGCCCGACTGAGCCTACAGTGACGGTGACTGCAACGTCCTCT
GCATCTACTACTCTGACGACGCTCACGACTCTGCCCTCGCCCACAGACTCTGCTACTGCCACTTCTGCTTCTACTTCTGC
TGATTCCACTACTATCTCCAGCACATCCAGTGCTTCTGACCCGGCTGGCTCTTCCACTCTCGTTCCCACCTCAGAGCCTA
GCGCCTCTGAGCCTAGCACTTCAGAGCCCAGTTCATCTACCGGTACTCCAGGGACTTCGACCAGTGATCCTGATCCCACG
AGTGCCACTGAGCCGTCCAGTACTTCGACCTCGACTCCCGAGCCTTCAGGTACTGTGACTTCAAGTACTTCGACTTCGAG
TCCTAGTACTAGCCCCCCCAGCACTTCCAGCACTTCCAGCACTAGCCCGTCTAGTACCTTGACCTCTACCTCATCCCCCT
CTACGTCTTCTACCTTAACGCCCAGTGCCAGCCCTACCCCGTCTACTACAGTGACCCCGTCCCCCAGCATGTCTGTTACT
TCCACTAGCGTGGCACCCTCGGCCACCGGGTCCCTGGCCAACAACATCCTTGTCATCGCCCGCGACTCTACGCAGGCCAG
CGTTGCCTCGTCCGGCCTGAATGGCTACGGAATCCCCTTCACGACGCTCCTGGTCCCTCAGGCCGGCGTCGAGCTGCCGG
CCCTGAACTCCTCCTCAGGGGGCAACTTTGGCGGTATCGTCGTTGCCGGCGAAGTCAGCTACGACTACGGTAACGATAAC
TGGCGCTCCGCCCTGACGGACGACCAGTGGAACCAGCTGTACGCGTACCAGCTCGCCTACGGCGTGCGCATGGTCCAGTA
CGACGTCTTCCCCGGTCCCAACTTCGGCGCCTCGTCCATCGGCAACGGCGGCTGCTGCGCCGACGGTGTCGAGCAGCTCG
TCTACTTCACGGATACCAGCGACTTCCCCACGGCCGGCCTCAAGACCGGCTCCAGCGCGGGCGTCTCGACCTCGGGTCTC
TGGCACTACACGGCTTCCGTCACCGACACCAACACCACCAAGGCGGATTGCGTCGTTTGCCTCCGGCGGCGGGGTTGACGG
CGAGTCTGTGGCCGCGGTCATCAACAACTTCGATGGCCGCCAGCAGATGGCCTTCTTCATCGGCTTCGACACTGTCTGGT
CCCAGACCTCCAACTACCTGCAGCACGGCCTGGATCACCTGGATCACGCGCGGGCCTGCACGCCGGGTACCGCCGCGTGAAC
CTGAACACGCAGATTGACGACATGTTCCTTGAGACCGATATCTACCAGCCCAGCGGAACCATCTTCCGCATCACGACCGA
TGATATGGACGGCATCACCAACTGGCTGCCCAGCATCCGCGCCAAACTCAACGCTGGAAGCACCTACTTTGTCGAGATCG
GCCACAACGGCAACGGCAACATCGAAGCCGGCACCACCAGGGCGGCCGGTGAGAGCACCTGCTCCGGCGGCGCCATCGAGTAC
GACTCGGCCTCCGGACACGGCCCTCGAATTTGTCAAGGCCTATCGGCACCGGCACTGACGTCTGGCCAACCTCGCCGACCAA
CTTCACCTGGACAACGACCTGCATGAACGCGGACAGCCTGCTCATATGGTTCCAGAACCACCTGGACGACTACGCCTACA
TCAGCCACACCTTCACCCACTTGGAGCAGAACAACGCCACCTACAGCGACATCTACAAGGAGATCTCCTTCAACCAGGTC
TGGCTCGAGCGTGCTGGCTTCTCGGCCGCGTCCAAGTTCACCTCCAACGGTATCATCCCGCCCGCCATCACCGGCCTGCA
CAACGGTGACGCTCTCCGCGCCTGGTGGGACAATGGCATCACCAACTGCGTCGGCGATAACACGCGTCCTGTCCTCCTCA
ACAGCGAGAACGAGATGTGGCCCTACTTCACCACTGAGGCCGCGGACGGGTTCGCGGGTATGCAGGTCAACCCGCGCTTC
GCGACTCGAATCTACTACAACTGCGACACCCCTGCCTGCACGACACAGGAATGGATCGATACCTCTGCCGGCGCGGAGA
CTTCAATGACCTGCTGGACACAGAGCGCGCCGAGGTCCTGCGTCACTTGTTCGGCCTCCATCGCGACCCGTACATGTTCC
ACCAGGGCAACCTGCGCAATGTCGGGATCGACCCCATCACCGTCGGCTCTGAGACCGGGCCAGTTCTCCATCTTCCAGGCG
TGGGTTGAGACCATCGTTGCCGAGTTCACCCGGCTGGTGGACTGGCCCATTGTTACGATTACGCATCAAGAGGTACACTT
CCCTCTGCTTTCCCTCTGCTTCCCCTGCTTTTCTACCGCTCTGCTTTAATTCTTGCGCTTGCTTTCCTCATAGTTACAGCT
TGCTAACTAAAGTAGATGTCCGCCGAATTCCTCGCCCGCTACACCCGCGACCACTGCGACTACGGGCTCAACTACATCCT
CGACAACGGCGCTATCACCGGCGTCACCGTGACTGCGAACGGCAACACCTGCGACGCGAACATCCCCGTTACCTTCCCGA
CCGCGCCTACGGACACCCTAGGCTTCGCGACGGAGCAGCTGGGCAGCGACCCCTTCACCGTATGGGCGCAGCTCTCCGGC
TCGCCCGTGACCTTCTCCCTTGCCACGCCAATTGCACTCTAG
```

Fig. 48
PUTATIVE AMINO ACID SEQUENCE OF Aspergillus nidulans Gtb3 (Genbank accession No. AN2955)

MTQILHVSPVGWDHMKNHWWQFSRRRPEKVSPRVSAKIDGLANRHLNLANRPTGQKPSSVGIYLGGLDEHLSDYQRRFLD
EWDMLIVDPYQSGVVEAVATAAGKQILGRLDLQDVASKEDAALAAIEKIDSALSQVFERSAFSGILLANWENKLSSECWA
SLLQAIQKLGLSVFLETAPPDFLPDRLVLQNQAISGLVVKNASILPNGQKRDYFQLQSMKSTIKAFVSEACMRDFTVVAW
ETIDDDASLSNAVVRRSLQWCNFYSAIPWIGCRAALKDVKLNTKLPEPLSSFSWLKEPEIMSAHDRWRANSSIEDVNGVV
SSGWDELLPFFPTLSNLIASSERDNGAHEDLTMAIRDPPDWVSLTKSQTNPLSTSIGGLEYNSFGCFPLGAEATAGSFAE
ILKSQQRLKSLGLLHPVPLAKMQSLATLLRQFHDGFALSAWGSSDPVPGHIKELSNLAANEQLRVYLGLDSGFRKNTDIR
FWGVYHMDSEGFDVFVSKKVQGLAGTVLHTYLSAKGCPRHVCFGAETALAKWTKDLVEEIGLPRRLVQDIDVLSPEERLL
LLQHLSLTDAPSDLTKSICAYLQQQLIEGTSLVQLKQVNTVSYLEGSASPETLVNSRVKWYREQGCSYPSPSVCLSLFRE
VEATFPQILKERREADLAQISRGLCQLMQGKQVDAYTDILALALFCAARKGALDEIYQEVTDRNPLFNAHSDQAAAFAES
FALGSRCESYFDISPSAFGKLLSDRFRKSYKDGDLPDWINGAPEMATSYAGAQIDVNPDDKVKPMRGYQRFTFLSVFAFP
ALIDIILLTLIGRGLYLSAFMTYEEQNSATTALMISLLLSGGIGTWIACGGPYYLISMAFAATNMFVFIRLIAGLAFTIA
GGLIGFVVVSGVNGPRAGIVFYLYLVALTTYFSGFACLASFSYPGSTFLSGRKIIFACIPILFISPIVTTFTGHDSAIYI
AVIYVFIGALILGLRSVASKWVTWYQKLRKTDDTEIRKWYVETYGNGDEKVFGGLSDPAVLKLSREALLKDVTAERNRWF
FSRPTTKSTLVLELARDWEATNFLLEWYCRYADVPRPIPYSSGWNTQTKVALESLKAAQRGIRLHNAFIHWRQSSREIGC
GMLYFIVALLDKWVELLSGGHLIGLSASLTTAYRMAVGFSLAYYLIGAVLIDTKAQELHSLVGSHTPVPLKTAKDIRDSQ
KRDVRFKRKVYWKTLGKYLMWHSWGLAFSTALVWTFQSHMEAMVMFLSYVAAYTGLLWYQYTKIFTGPHALKPLLVGSLV
GLPLGIALKVCLPHFMYSQVVGLGAATWTVAFLSLIPAKMGMPKRVDSPVELGKTFHAYTAPWDDPDWSQQELQTFYESI
SLIPSDARLKLVPASHPGSEVKQMLISRRKEPRIEEAFPHSQELVDTALKAWEAGEVLLELVPLGSIGPNVHALSCSTSD
HLKIAIAVGRGLDHRIDVSANCQVIAETLLHAVAESIMQIPHEQAVLAESLVAAGVTETTARQLREEADTPLVVRWAKKE
LLRQLCLGFECDFHWEKLPRAVRKALLDRCLGQPCRLSEKHYRWLEESICQFDIKDLAVHIARSNLAAAAAVSILDYANY
GTGESATYKESETPAYIPYLPKQLPTVAYFIMKPLFSVYYKVAIALKFVVVALVADPEFQREYNHVMSPYPAIIRVPATF
ALSMVWNYAKIMQDLGLTFFLFHGRDNVKQLWDETKGMTINIKKSRYIVQSLDGTFTAFRHNQPDGGFKVYYYTGTPKTE
PQGTKSLSCVSTYSKDLLLLIRQEYKGGNIVNEYHYDYRTPTKKGITLKLTDRKVPMGRRCVRGTNHLQSVQYNRKGLIE
AGSYMKDGNLIRFKYHYRKNPQFGDELLRAEFALSHITCTVSWCAPPLRHPEKVDRWIPHAKVTEATFVQGGPDVYEARWL
YDHKFHPTIFTTLNGQKIQTPPMIEHDYLGVLAKPRLTSFVHDNPLFYCDSLSSNIFTRILGLTRKRFPVSISRARSLIW
KAWKEKADFDGITVRWMDERLLRRDRTLSPYWRSRDWGDLTSAKKYLELRADTIAASADLDDGISSWTPLAVKVSDLFNF
GPGGDAVVNTRSNDFGSDTEKSLHVMAADNGTWPNEGGGVSACRRDMINSLRTIKWHMICESANDFGVPKHQTEQNILSL
KVIPLWGMDFLTPTHGLFRNKLDAEVESVTSANDMDIKMNFIPILTALVKGARAVHLSKADIRQATRALVNLNTFFQDSR
HWTQIWNSEIVKESWRDLWLTQEMPNTMPSAEWFSTDLPTLGTLDVALELWYRYLFIFSIPIPEKIPSVFQASHHSVSAS
YGVVCKIKRNCTLQIWDHAIAWRETNLCLSSALCKLSPFVRNALLGLMRVTSALTLYHADIISPCADFFNPGWEVEIGTC
QGTIEHRNIFRRKVDPVVNGITDMQKFAPVKEIKSERPTVTMLSHVWYAKDIKTALLAADIIINQWKFDDYHLDIYGAID
KAPTYSTECQEIIASKGLRGRVTLRGTADPMKVLESTWLFLNSSLSEGLPLALGEAALTGAPVVCTDVGASLRVLSDPDD
FSRFSAVVAPNDALALARAQISMLALLGEWSQYAEDTEPAPILPSSPTPEDVAKITQRMYDKSEHRRKLGMMTRKIVQKS
FSGDRYLREHEQMLWIGKSAKMMATRAPGLHEPADIATAIQQTLPIEEEVITIPRSAVHSWRSSAASGMSTLYTSYTSST
TPFSHLNPNNQPPTRSSYYAPAHTSASANLLTRPSSLYSAISNASTTDASSFLPLPNTPLPVFAPRHSFALPSAPGANGG
NGGGISRPLSPAGRRSPLFTRARHSRSRSGSLSTGGREQLRGLQREDLQQYRNSDVSTIMREDFFQSSIYRGIEGGNNQV

Fig. 49
BASE SEQUENCE OF NUCLEIC ACID MOLECULE OF Aspergillus nidulans gtb3 (Genbank accession No. AN2955)

ATGACCCAAATCCTCCATGTCTCGCCCGTCGGGTGGGATCATATGAAAAATCACTGGTGGCAGTTTGTGAGCCCCCTGAT
CCATGCATCCTCCAATTTCTTTTGTTAATGCTTCTAGGTTTTGATTGGTATTCTACTGGGCAGCGTTACAGTTGGAACAG
TATACCTTGTATATTCTTCAGTACTACGATGCATAATTTATTTGGAGGTAAACTAAACACCTTTTTACATGCATACCGCT
GCCACATGGACCTTGCTGACTTCCGTCTAGTCAAGGCGGCGCCCTGAGAAGGTGTCCCCCAGAGTATCCGCAAAGATCGA
TGGGTTGGCAAACAGGCATCTCAACTTGGCCAACCGCCCAACGGGCCAAAAGCCCTCGTCTGTCGGTATCTACTTGGGAG
GCCTGGATGAGCATTTGAGCGATTATCAACGTCGCTTCCTAGATGAGTGGGATATGTTGATTGTCGATCCCTATCAGTCA
GGAGTAGTCGAAGCCGTTGCAACTGCTGCAGGTAAGCAGATTCTTGGCCGACTCGATCTTCAGGATGTGGCTTCCAAGGA
AGATGCGGCTCTAGCGGCAATCGAGAAGATCGACAGCGCTCTGAGTCAGGTCTTTGAGAGATCGGCCTTCAGCGGTATCT
TGCTCGCCAACTGGGAGAACAAGCTCTCCTCTGAATGTTGGGCCAGCCTGCTTCAAGCCATCCAAAAGCTGGGGCTGTCA
GTCTTCCTGGAGACTGCGCCTCCAGACTTCCTCCCAGACCGGCTTGTGCTACAGAACCAGGCCATCTCCGGCTTGGTCGT
TAAGAACGCCAGCATCCTCCCTAATGGTCAGAAGCGGGATTACTTCCAGCTACAGAGCATGAAATCAACAATCAAGGCTT
TTGTGTCTGAGGCATGCATGAGAGATTTTACAGTCGTGGCTTGGGAAACGATTGATGACGACGGCTCTCTATCGAATGCC
GTGGTCCGAAGGTCGCTGCAATGGTGCAATTTCTACAGCGCGATCCCTTGGATCGGCTGTAGGGCTGCCTTGAAGGACGT
CAAGCTGAATACGAAGCTGCCAGAGCCTCTTTCTTCCTTCAGCTGGCTTAAAGAGCCGGAAATCATGAGCGCGCACGATC
GCTGGAGGGCCAATTCATCCATCGAAGACGTCAACGGTGTCGTCAGCAGCGGATGGGACGAGTTGCTGGCATTCTTCGCA
ACCTTGAGTAACCTCATTGCATCGTCAGAACGCGATAACGGCGCTCACGAGGATCTTACCATGGCAATCGGTGACCCTCC
TGACTGGGTTTCTTTGACCAAGTCCCAAACCAACCCCCTCTCTACTTCTATCGGAGGACTAGAGTACAACTCGTTCGGTT
GCTTTCCATTAGGCGCGGAAGCCACTGCGGGCTCCTTCGCCGAGATCCTCAAGTCCCAGCAGCGTCTCAAATCGCTCGGC
CTGCTTCATCCAGTTCCTCGTTGCCAAAATGCAAAGTCTGGCGACTCTCTTGCGTCAGTTTCACGACGGATTCGCGCTTTC
GGCCTGGGGCTCCTCAGATCCAGTCCCTGGCCATATCAAAGAGCTTTCCAATCTTGCTGCCAATGAACAGCTTCGTGTGT
ATCTCGGGCTCGACTCTGGGTTCCGTAAAAATACCGATATTCGTTTCTGGGGTGTATATCACATGGACTCCGAAGGATTC
GACGTATTTGTGTCGAAGAAGGTGCAAGGCCTCGCTGGCACTGTTCTGCATACTTATCTCTCTGCAAAAGGCTGCCCTCG
GCATGTTTGCTTTGGAGCAGAAACTGCATTGGCCAAGTGGACCAAAGATCTCGTGGAAGAAATTGGCTTGCCTCGTCGCC
TGGTGCAAGATATCGACGTCCTGAGTCCCGAGGAACGACTTCTGCTCCTGCAGCACCTATCTCTGACAGATGCACCAAGT
GACCTAACCAAGTCGATTTGCGCGTACCTCCAGCAGCAGCTCATAGAAGGGACATCTCTCGTACAACTTAAGCAGGTCAA
CACAGTCTCATATCTTGAAGGGTCTGCATCTCGGGAGACATTAGTGAATTCTCGCGTGAAATGGTACCGAGAACAAGGCT
GCAGCTATCCTTCGCCCTCGGTATGCCTGTCTCTCTTCCGTGAGGTCGAGGCGACCTTCCCTCAGATCCTCAAGGAGCGC
CGCGAAGCCGATCTTGCTCAGATCTCGCGTGGTTTGTGCCAGTTGATGCAAGGTAAACAAGTCGACGCTTATACTGATAT
CTTGGCCCTTGCGCTGTTTTGCGCTGCGCGAAAAGGAGCCCTTGATGAAATCTATCAGGAGGTGACTGATCGGAACCCAT
TGTTCAATGCTCATTCCGATCAGGCCGCTGCCTTCGCCGAATCCTTTGCTCTTGGATCTCGCTGCGAGTCCTATTTTGAC
ATCTCACCCAGCGCTTTCGGAAAATTACTGTCTGATCGGTTCCGCAAGAGCTACAAGGACGGAGACCTTCCGGACTGGAT
CAACGGCGCTCCAGAGATGGCTACATCGTATGCCGGCGCCCAGATCGATGTCAATCCTGATGATAAAGTCAAGCCAATGC
GCGGATATCAGCGGTTCACCTTCCTCAGTGTCTTTGCCTTCCCGGCCTTGATCGATATCATTCTCCTTACCCTCATTGGA
CGTGGACTGTACCTCTCAGCCTTCATGACTTACGAAGAGCAAAATAGCGCCACCACTGCCTTGATGATTTCGCTACTGTT
GTCTGGAGGCATTGGTACCTGGATTGCTTGCGGTGGCCCCTACTACCTCATTTCGATGGCTTTTGCTGCAACGAACATGT
TCGTCTTCATCAGGCTTATTGCCGGTCTAGCATTCACTATCGCCGGTGGCCTCATTGGATTTGTTGTGGTGTCAGGCGTG
AATGGCCCACGGGCTGGAATTGTCTTTTACCTCTATCTTGTCGCCTTGACCACCTACTTCTCCGGATTTGCCTGTCTCGC
GAGCTTCAGCTATCCCGGCTCTACTTTCCTGTCTGGGCGCAAAATCATTTTCGCATGCATCCCCATTCTGTTCATCTCGC
CCATTGTTACCACCTTTACCGGCCACGACTCTGCGATCTACATTGCGGTCATCTATGTTTTCATCGGAGCTCTGATATTG
GGTCTGCGAAGTGTCGCTTCAAAATGGGTAACCTGGTACCAAAAACTGAGGAAAACAGATGACACAGAAATCCGGAAATG
GTACGTCGAAACATATGGAAACGGAGATGAGAAGGTATTTGGAGGTCTCAGCGACCCAGCCGTGTTGAAGCTGTCGAGGG
AGGCACTCCTGAAAGATGTAACAGCAGAGCGTAACCGCTGGTTCTTCAGCAGGCCTACGACAAAAAGCACCCTTGTTCTT
GAGCTCGCCCGGGACTGGGAAGCCACGAACTTCCTCCTCGAGTGGTATTGCAGATACGCAGATGTTCCCAGACCCGATTCC
CTATAGCTCGGGGTGGAACACGCAGACCAAGGTTGCACTAGAGTCTCTCAAGGCTGCCCAACGGGGTATCCGCTTGCACA
ACGCTTTTATCCATTGGCGTCAATCAAGCAGGGAAATCGGCTGTGGAATGCTCTACTTCATCGTCGCCCTTCTGGACAAG
TGGGTGGAACTTCTCAGCGGTGGCCACCTTATCGGTCTCTCAGCGTCCTTGACGACGGCTTACCGAATGGCAGTCGGTTT
TTCGTTGGCCTACTACTTGATTGGGGCTGTGTTGATTGACACCAAAGCTCAAGAGCTTCACAGCCTTGTTGGAAGCCATA
CCCCGGTGCCTCTCAAAACCGCTAAAGATATTCGAGACTCGCAGAAGCGAGACGTGAGGTTCAAGAGAAAGGTCTACTGG

Fig. 50

```
AAGACAGTTGGCAAGTATCTTATGTGGCATTCATGGGGCCTTGCTTTCTCAACAGCCGTTGTATGGACGTTCCAGTCGCA
CATGGAGGCAATGGTCATGTTCCTCTCGTACGTTGCGGCGTACACCGGCTTGCTCTGGTACCAGTACACGAAAATATTTA
CTGGCCCTCATGCGCTGAAGCCGCTGTTGGTTGGCTCTCTCGTCGGCCTACCGCTTGGTATCGCGCTGAAGGTCTGCCTT
CCGCACTTCATGTACTCGCAAGTGGTCGGCCTAGGAGCCGCCACATGGACAGTCGGCATTCCTCTCGCTCATACCGGCCAA
GATGGGAATGCCTAAGCGCGTCGACTCCCCGGTAGAGCTTGGCAAGACGTTCCACGCTTACACCGCACCCTGGGACGATC
CCGACTGGAGCCAGCAGGAGCTGCAAACATTTTACGAAAGCATTTCTCTCATTCCCTCGGACGCTCGTCTCAAGCTTGTG
CCGGCTAGTCACCCAGGATCAGAGGTGAAGCAAATGCTTATCTCGCGGAGAAAAGAGCCGAGAATTGAGGAAGCGTTCCC
CCACTCCCAGGAACTTGTCGATACGGCGCTGAAAGCCTGGGAGGCTGGCGAGGTCTTGCTTGAGCTAGTTCCTCTAGGCT
CAATTGGGCCTAATGTTCACGCACTGAGCTGTAGCACTTCTGACCATCTGAAGATTGCTATCGCTGTGGGAAGAGGACTA
GACCATCGCATCGACGTTAGTGCCAACTGCCAGGTCATTGCCGAGACTCTTCTCCACGCTGTTGCCGAGTCGATAATGCA
AATACCCCATGAACAGGCAGTGCTCGCTGAGTCGCTTGTGGCTGCTGGTGTGACGGAAACCACCGCCCGCCAGCTGCGCG
AGGAAGCTGACACGCCTCTTGTTGTACGGCTGGGCCAAGAAAGAGCTTCTGCGCCAATTATGCTTGGGCTTCGAATGTGAC
TTTCACTGGGAGAAGCTGCCCAGGGCCGTTAGAAAGGCTCTTCTTGATCGTTGCCTTGGCCAACCATGTCGACTTTCCGA
AAAGCACTACCGGTGGCTTGAGGAGAGCATCTGTCAATTCGACATCAAAGATCTAGCGGTCCACATCGCCCGCAGCAATC
TTGCAGCTGCAGCGGCCGTCAGTATCCTGGATTATGCCAACTACGGAACAGGTGAATCGGCGACTTACAAGGAGTCCGAG
ACACCCGCATATATCCCTTACCTGCCCAAGCAACTTCCGACAGTGGCTTACTTTATCATGAAACCGCTGTTCTCGGTGTA
CTATAAGGTTGCTATCGCTCTCAAATTCGTGGTTGTCGCCTTAGTTGCCGATCGGAGTTCCAGCGAGAGTACAATCATG
TTATGAGTCCTTATCCCGCCATCATTCGGGTGCCGGCTACATTCGGCGCTGAGCATGGTCTGGAATTATGCCAAAATCATG
CAAGACTTGGGGCTTACATTCTTCCTATTCCATGGTCGTGACAATGTCAAGCAGCTCTGGGATGAGACAAAGGGTATGAC
AATCAACATCAAGAAGAGCAGGTACATCGTGCAGAGTCTCGATGGGACATTCACAGCTTTCCGGCACAATCAACCAGATG
GGGGATTCAAAGTCTACTACTACACTGGGACTCCCAAGACAGAGCCGCAGGGAACGAAGAGCCTCAGCTGTGTCAGTACA
TACTCGAAAGACCTCCTGCTGCTCATTCGCCAAGAGTACAAAGGTGGTAACATTGTCAACGAATACCACTATGATTACCG
CACCCCGACGAAGAAGGGTATCACCCTGAAGTTGACTGACAGGAAGGTCCCAATGGGCCGACGATGCGTGCGCGGGACAA
ACCATCTCCAGAGCGTACAGTACAATCGTAAAGGACTCATCGAGGCTGGCTCTTACATGAAGGACGGCAATCTCATCCGC
TTCAAGTACCACTACCGAAAGAATCGCCAGTTTGGCGATGAGCTGCTCCGGGCTGAGTTCGGCCTTGTCGCATATTACCTG
CACTGTGTCGTGGTGTGCACCGGCCGCTCCGCCACCCTGAGAAAGTCACGGTGGATTCCTCATGCAAAGGTCACCGAGG
CGACCTTTGTCCAGGGCCCTGACGTCTACGAGGCACGCTGGCTGTACGATCACAAGTTCCACCCGACCATCTTCACTACG
CTCAACGGACAGAAGATCCAGACCCCGCCGATGATCGAGCATGATTATCTTGGAGTTCTAGCAAAACCCAGGCTCACGAG
CTTTGTGCATGACAATCCTCTGTTCTATTGTGACAGTCTCAGCTCTAACATCTTTACCCGGATTCTTGGATTGACGAGGA
AACGCTTCCCAGTTTCAATTTCGCGTGCTCGTTCACTTATCTGGAAAGCTTGGAAAGAGAAAGCTGACTTTGACGGGATC
ACCGTGCGCTGGATGGACGAACGGTTGCTGCGAAGAGACAGGACACTATCGCCATACTGGCGCAGCCGTGACTGGGGTGA
TCTTACATCAGCAAAGAAATACCTCGAGCTCAGGGCTGATACCATTGCGGCGAGCACATCTTGACGATGGCATTTCCA
GCTGGACACCCTTGGCTGTCAAAGTTAGCGATCTCTTCAACTTCGGTCCCGGAGGTGACGCTGTGGTCAACACGAGGTCC
AACGACTTTGGATCGGACACAGAGAAGTCCCTTCATGTCATGGCGGCGGATAATGGTACTTGGCCCAACGAAGGAGGTGG
TGTTTCTGCTTGTCGGCGGGACATGATCAACTCTCTGCGCACAATCAAGTGGCATATGATCTGCGAGTCGGCGAACGATT
TCGGCGTGCCGAAGCATCAGACGGAGCAGAACATTCTCTCGCTCAAGGTGATTCCGCTATGGGGAATGGACTTGCCTTACA
CCAACGCACGGCCTCTTCAGGAACAAATTGGACGCGGAGGTTGAGACGCTCACGTCTGCGAATGATATGGATATCAAGAT
GAACTTTATTCCCATCCTAACAGCCCTCGTCAAGGGAGCCCGTGCCGTGCATTTGTCGCAAGGCCGATATCCGCCAGGCGA
CTAGGGCTTTGGTCAATCTCAACACGTTCTTCCAGGACTCGCGGCACTGGACACAGATTTGGAACAGCGAGATCGTCAAG
GAGAGCTGGCGGGATCTGTGGCTTACCCAGGAGATGCCGAACACGATGCCTTCGGCGTGAATGGTTCAGCACTGACTTGCC
CACGTTGGGAACCCTCGACGTCGCGCTTGAGCTTTGGTACCGCTATCTGTTCATTTTCTCGATCCCCATCCCCGAGAAGA
TTCCCAGCGTTTTCCAAGCGTCTCACCATAGTGTAAGTGCTTCGTATGGTGTTGTATGCAAGATCAAGAGAAATTGCACG
CTGCAGATCTGGGATCATGCGATCGCCTGGCGTGAGACGAACCTGTGCCTCTCGTCCGCTCTTTGCAAGCTTTCCCCGTT
TGTTCGAAATGCGCTACTCGGTCTGATGCGAGTCACATCCGCTCTCACTTTGTATCATGCCGATATTATCTCCCCGTGCG
CCGACTTCTTCAACCCAGGCTGGGAAGTCGAGATTGGAACATGTCAAGGCACGATTGAGCACCGACATCTTCCGCCGC
AAGGTCGACCCAGTCGTCAATGGTATCACCGACATGCAGAAGTTCGCCCCAGTTAAGGAGATCAAATCCGAGCGGCCTAC
AGTGACGATGCTTTCGCACGTCTGGTACGCCAAGGACATCAAGACCGCGCTTCTCGCCGGCAGACATCATCATCAACCAGT
GGAAGTTCGATGACTACCACCTCGATATCTACGGTGCAATCGACAAGGGCCCTACTTACTCCACCGAATGCCAGGAAATC
ATCGCCTCCAAGGGTCTCCGAGGACGAGTGACCCTGCGCGGCACAGCTGACCCCATGAAAGTCCTCGAGAGCACCTGGCT
CTTCCTGAACTCTTCCCTGTCTGAAGGTCTCCCACTCGCTCTCGGCGAAGCAGCCCTAACTGGTGCGCCAGTGGTTTGCA
```

Fig. 51

```
CTGACGTGGGCGCCTCCCTTCGCGTCCTCAGCGACCCAGATGACTTCTCCCGTTTCAGCGCCGTCGTCGCCCCCAACGAC
GCACTGGCGCTCGCCAGGGCCCAGATTTCCATGCTCGCCCTCCTCGGCGAATGGTCTCAGTACGCCGAAGACACCGAGCC
CGCCCCTATTCTTCCATCATCACCCACGCCCGAAGACGTCGCAAAGATCACCCAGCGCATGTACGACAAGTCGGAGCACC
GCCGCAAACTGGGAATGATGACCCGCAAGATCGTCCAGAAGTCTTTCAGCGGTGACCGCTACCTCCGCGAGCACGAGCAG
ATGCTCTGGATTGGCAAGTCCGCGAAAATGATGGCCACGCGTGCCCCCGGCCTCCACGAGCCGGCAGACATCGCAACAGC
CATCCAGCAGACCCTCCCCATCGAAGAGGAAGTCATCACCATCCCCCGCAGCGCCGTACACTCCTGGCGCTCGTCCGCGG
CCTCTGGTATGTCCACCCTGTACACGAGCTACACTAGCTCCACCACTCCCTTCTCCCACTTGAACGCCAACAACCAACCA
CCCACCCGCTCAAGCTATTACGCTCCTGCACACACATCCGCATCGCCAACCTCCTCACCCGCCCATCCTCCCTCTACTC
CGCCATCTCCAACGCTTCCACAACGGACGCCTCCTCCTTCCTGCCGCTCCCCAACACCCCCCTTCCCGTTTTTGCCCCGC
GGCACTCCTTCGCCCCTTCCCTCTGCTCCCGGTGCCAATGGCGGAAACGGAGGCGGGATTTCACGCCCCTATCGCCTGCA
GGTCGAAGGTCCCCGCTCTTCACGCGCGCTCGCCATTCGCGATCACGCTCCGGTAGTCTCTCTACGGGCGGGCGGGAGCA
GCTCCGCGGCCTACAAAGGGAGGATCTGCAGCAGTATCGCAATTCCGACGTTAGCACCATCATGAGGGAGGACTTCTTCC
AGTCGAGTATCTACCGCGGGATCGAGGGTGGAAATAACCAGGTTTAA
```

Fig. 52
PUTATIVE AMINO ACID SEQUENCE OF Aspergillus sojae Uge3

MESLQQSDASTPVEPYSPECVDTPATQSSVLFDGNLEELLRNFPLDQYILVTGGLGFIGSHTTLELLKANYNVIVIDNLS
NAFQNVFDRIKLLASKHHEQQGTKMPEMHLHAHDYRDSVALRKLLEQYQIQSRWGTPKTKISGVIHFAAHKAVEESIRNP
LKYYANNVGGLIDFATTLGEFGIKTFVFSSSATVYGTLATSGLPLKEELCVHKDEIFEDRDGSKKLMEPGCTGITNPYGR
TKWICEAILADLAASDPEWTIVALRYFNPVGCDESGLLGEDPKQIPTNLLPVVVKVMTGQYKELQMFGTDWDTEDGTAVR
DFIHVTDLARGHIAALSAANEGKLKENFRTFNLGTGTGHSVMEVVNTMESVSSKEIPRRAADRRAGDVGSCVAVATRSQE
ELQWKTEKTLTDACASLCNFLTVSGLSS

BASE SEQUENCE (PUTATIVE) OF NUCLEIC ACID MOLECULE OF Aspergillus sojae uge3

ATGGAGAGCCTCCAACAGTCTGACGCAAGTACTCCCGTGGAGCCTTATTCTCCAGAATGCGTCGATACACCAGCGACGCA
GTCATCCGTCTTGTTCGATGGAAATCTTGAAGAGTTGCTGCGCAACTTCCCCCTGGATCAATACATCCTCGTCACCGGCG
GTCTCGGTTTCATTGGAAGTCACACAACATTGGAGCTACTCAAGGCCAATTATAACGTAATCGTCATTGACAACCTTAGC
AATGCTTTCCAGAACGTCTTCGATCGCATCAAACTCCTGGCTTCCAAGCACCATGAGCAACAAGGAACCAAGATGCCCGA
GATGCATCTGCATGCCCATGATTACCGCGACAGTGTTGCTCTTCGCAAGCTTCTTGAGCAATATCAAATCCAGTCCAGGT
GGGGTACACCTAAGACCAAGATCTCCGGCGTCATTCACTTTGCTGCCCACAAGGCAGTTGAGGAGAGTATCAGGAATCCT
TTGAAGTACTACGCAAACAATGTCGGCGGTCTCATCGACTTTGCCACGACGCTGGGTGAGTTTGGTATCAAGACCTTCGT
CTTCTCGTCGTCCGCCACCGTATACGGAACTCTAGCAACTTCCGGTCTTCCCCTCAAGGAGGAGCTTTGTGTCCACAAGG
ATGAGATCTTCGAAGACCGTGACGGGTCCAAGAAGCTCATGGAGCCTGGGTGCACAGGTATCACAAACCCCTATGGGCGC
ACAAAATGGATCTGCGAAGCCATCTTAGCCGACCTCGCGGCCTCCGATCCAGAGTGGACAATCGTGGCTCTACGATACTT
CAACCCGGTTGGATGCGATGAATCCGGCCTTCTCGGCGAAGATCCCAAGCAAATACCTACCAACCTTCTTCCAGTTGTCG
TCAAGGTCATGACTGGGCAGTACAAGGAGCTGCAGATGTTTGGAACCGACTGGGACACGGAAGATGGCACAGCTGTCCGT
GACTTCATCCACGTCACCGATCTGGCTCGAGGACATATCGCAGCCCTCAGTGCTGCCAACGAAGGGAAGCTCAAGGAGAA
TTTCCGCACATTCAACCTCGGAACCGGTACAGGCCATTCCGTAATGGAGGTGGTGAACACTATGGAGAGTGTGTCTTCCA
AAGAAATCCCGAGAAGAGCTGCTGACCGCCGCGCGGGCGATGTCGGTTCCTGCGTTGCTGTGGCCACCAGGTCACAGGAA
GAGCTGCAGTGGAAGACCGAGAAGACATTGACCGATGCCTGTGCCAGTCTGTGCAATTTCCTGACTGTCAGCGGACTGTC
CTCTTAG

Fig. 53

PUTATIVE AMINO ACID SEQUENCE OF Aspergillus sojae Sph3

MGPDKHVSGRRCLQSRRSRIILGVFVFIAILAVVIPPAVVVTLRKKNSMGPKANIFVPLYVYPAPGAWDPLEAEISSHPE
ANFTVVINPASGPGPNALPDANYTREIPKLASYDNVRLLGYVPTTWAKRNISAVRRDIATYAEWPTNSSNPKLAVRGIFF
DETPQQYDADALSYLQELTSFVKGLSGLGPDNFIVHNPGAVPDSRYMSSADSTVVFEAAYDTFNERNGTKQFDVLPKSDR
GRGQLCIVIHSVPDEVEGSKLRELVKKLRKTADEIFITHLSTDYYANFGDRWGEFVDWMAK

BASE SEQUENCE (PUTATIVE) OF NUCLEIC ACID MOLECULE OF Aspergillus sojae sph3

AATCCACTTTCTTGCCCTCCTTTCGTTGCATACTCCGGAGTACTAAGGCATTCACATTTTAATTGCCTCCCTAACGTGGG
AACGATGGGGCCAGACAAACACGTGAGCGGTCGTCGCTGCCTGCAAAGCCGACGTTCTCGAATCATTTTGGGGGTCTTTG
TCTTTATTGCTATCCTCGCGGTCGTTATACCTCCCGCAGTCGTGGTCACCCTACGCAAGAAGAACAGCATGGGCCCTAAA
GCTAACATCTTCGTCCCTCTCTATGTGTATCCTGCCCCTGGCGCCTGGGATCCATTGGAAGCAGAGTATGTCTGAATATT
TTTTTATGCCTATTTGTATTTCTAATTCTTCCCTTCCATTTCACCCCCACTACTTCCCCTCACCCCCAAAAGCCCAGTAT
GTTCTGGTCCCTGGTATATACATTGTACACCATAAGCAAGCTGAAAGCCAATTGCATGATGCATGCAAGTGGGAAGCTAT
AATTTGGGGGAAAGTAACTAAGCGCCACAGGATCTCTTCACATCCGGAGGCCAACTTTACCGTTGTGATTAATCCTGCCA
GCGGCCCAGGGCCCAATGCCCTGCCCGATGCCAATTATACTCGAGAGATTCCCAAGCTCGCCTCTTATGACAACGTGCGT
CTCTTGGGTTATGTCCCTACAACCTGGGCCAAACGCAACATCTCGGCCGTGCGTCGCGACATCGCAACCTACGCAGAATG
GCCGACCAACAGTTCCAACCCTAAGCTCGCGGTTCGGGGTATATTCTTTGATGAAACGCCCCAACAGTATGATGCCGATG
CGTTGTCATATTTGCAAGAGCTCACCTCATTCGTGAAAGGCCTTTCTGGTCTTGGTCCAGACAACTTTGTACGTGTGACC
CTTCTCTTTCACCCCTCTGTAATTTGTATTACCGCTCGGTATTCATGGTAATTTACATGGGTACATACCTCATGCCCCCG
TACCTTCTCCACCCTCTGTGTACTTTTTATGCTTTTTCACTTTTGCCAATATGGTCCATACCTGCCTTTTTGCTAGGTTC
TATTACGGTTTTCGACTGCAACTCCGACAACCTCATTGGGTCAATTTTATCAACGATGATGCTAATAGTGGCTGTCTAGA
TTGTCCATAACCCGGGAGCCGTTCCAGACTCTCGTTACATGTCTTCAGCTGACTCGACTGTCGTATTCGAAGCGGCTTAT
GACACCTTCAACGAGCGTAATGGCACGAAGCAATTCGACGTTCTTCCGAAGAGCGATCGCGGTCGCGGTCAGCTCTGCAT
TGTGATCCACTCCGTTCCGGATGAAGTTGAAGGTTCGAAGCTTCGTGAGCTCGTCAAGAAGCTTCGCAAGACCGCCGATG
AGATTTTCATTACCCACCTGAGCACGGATTACTATGCCAACTTTGGGGATAGGTGGGGCGAATTTGTCGATTGGATGGCT
AAATAATCCCTACGGGCGGCGCTTTTCGAGCATACCTGATGCAACATTGCTTATGATCAGGACCCGATTGGCGTCGACTG
ATAATATATGCGCCGGCGCTTTGATGGATTGGATTGACTAATCAACTTACGACCTGTCTATACTGTATGAACGTCTATAT
CCTGTATGGTTATTCTGCTGATAATATGCTATTTGACTTTGGCCGTTGTGACTATCAAATGATACCTAGAATTACGATAG
AGTTTACGATCGTCAAGATTTCCTTTTTGTTGTC

Fig. 54

PUTATIVE AMINO ACID SEQUENCE OF Aspergillus sojae Ega3

MAGIDEALPLKGKGQAASGWKTWSGKKRMLIIGAIALVIALAIGLGVGLGVGLNKGGGEDEGEVPPTTGGGVTTAKWQPA
VGTKWQIELLYALNDTSVDADIYDIDLFNNNKSTINDLQKQGRKVICYFSAGSYENWRPDKDKFKDSDMGNTLDGWPDEK
WLDLNSKNVRSIMTSRLDMAVEKNCDGVDPDNVDAYDNDNGLDMKKEDSANFMMWLANETHARNMSIGLKNAGAIIPAVI
DNMQWSVNEQCAQYEECDTYAAFIDKNKPVFHIEYPKGDDTNNNDLVSTSQKKSACDFEGSSNFSTVIKNMNLDNWIQTC

BASE SEQUENCE (PUTATIVE) OF NUCLEIC ACID MOLECULE OF Aspergillus sojae ega3

CCGCAGGTGACCTCGAAACAACAGCCACTGTGGCAGAGTCCATTGTTTGGACAGCGACTGCCGCAGTCTGTAAGGCATTC
ACTTGCCTTTAATTCCAACCCAGGGCAGGCGTCTCTGCATCCGATTCCCCGGACCACCTCAACGCAATCTCTGAACAAGC
CACTTCATAGTTTCAGTGTAACCGCGGAGAGAGGGATTTCTTTGTCCTCTCCTAGCCTATACATTTAACGGTTGCCTGTG
AACCCCTGTGGTTCTACTCCGGAATACGCCACTCTATTTGCTTCTTTATCTGATCGTTTGATCTTCATCTCAGGTCCTCT
TTATATTTTCCTTGCTTACCCCCCACCCACCTTACCGCTGTGGTTTGTGAAAATCAAATCGCAGGTCGTACCTTTCTTTC
TCAGAATTCCCTTCTTTGAACATTTCTTTCTTTAGCCCTTCATTTTATTGGAATTTTTCTTTGTGAAATCTATTGTACTA
TGGCGGGTATTGATGAAGCGCTGCCCTTGAAGGGCAAGGGACAAGCTGCGTCCGGCTGGAAGACTTGGTCTGGCAAGAAG
CGTATGCTGATTATCGGCGCTATCGCTCTCGTGATCGCTCTCGCTATTGGTCTAGGAGTTGGCTTGGGAGTCGGTCTGAA
TAAGGGCGGAGGGGAAGACGAAGGCGAGGTTCCGCCCACTACCGGAGGAGGCGTGACCACAGCCAAGTGGCAGCCGGCCG
TAGGAACGAAATGGCAGATCGAGCTTCTGTACGCGCTCAACGACACTTCAGTAGACGCGGATATCTACGACATTGATCTC
TTCAACAATAACAAGTCGACCATCAACGATCTGCAAAAGCAAGGCCGCAAGGTGATCTGCTACTTCTCCGCTGGGAGCTA
CGAGAACTGGAGGCCCGACAAGGACAAGTTCAAGGATTCCGACATGGGCAACACGCTGGATGGGTGGCCGGATGAGAAAT
GGCTTGACCTCAACTCCAAGAACGTGCGGAGCATCATGACGTCGCGTCTGGATATGGCGGTCGAGAAGAACTGCGATGGA
GTTGACCCGGATAACGTCGATGCCTACGACAACGACAATGGTCTCGATATGAAGAAGGAGGATTCGGCGAATTTCATGAT
GTGGCTCGCCAATGAAACGCATGCACGCAATATGTCCATTGGCCTGAAGAATGCCGGGGCAATCATCCCTGCAGTGATCG
ACAACATGCAGTGGAGCGTGAACGAGCAATGCGCGCAATATGAGGAGTGCGATACCTACGCCGCATTCATCGATAAGAAC
AAGCCCGTCTTCCACATCGAGTACCCCAAGGGCGACGACACCAACAACAACGATTTGGTCAGCACGAGCCAGAAGAAGAG
TGCTTGCGACTTTGAGGGATCCTCCAACTTTTCGACGGTCATCAAGAACATGAATCTGGATAACTGGATCCAGACCTGCT
AGTCGCACAATTGATCCGCATCTAGATACTCTGTTCGATCAGCAAGGGCGCCGGGAGTTTGAGATTGGGATTTCCACCAT
CCCCTTACCATCTATATAGTTTGACTATGATGTAATCTGCCTCATTTAATTAACTTTGACATTCGTCTCTTTCA

Fig. 55

PUTATIVE AMINO ACID SEQUENCE OF Aspergillus sojae Agd3

MVLPWLLRTGCYFGLITCDTPPGVWPEGIPSVIAPVPPSRTSGVTTNSPGFTSSVLSFTSSSSPPVTGSSSFVTITTTLA
SSTSTSTSTSLPSFTSTLVSVSTPVSASSTMSLIPSPSSSLIPSATPSASVIANGNVAGNILVIAKDTAAANVATSGLNG
YGIPFTTLLVPQSGATLPELNGTSGGNFGGIVVASEVSYDYGAQGFQSALTTDQWNQLYAYQLEYSVRMVQYDVYPGPNY
GASAVGGGCCDSGVEQLVSFSDVSDFKEAGLKTGAGVSTTGLWHYPASVNDTATTKEIARFAANGNYGSETTAAVINNFN
GRQQMAFFLSFDTTWSATSNYLQHAWINWLTRGLYAGHRRVNLNTQIDDMFLETDIYYPNGTTFRITTADMDGISSWLPT
INGKMNAGSSYFVEVGHNGNGVIESATGKDADACNGGGIEYDSPADTPLEFKKPLGTGTDLWPKDQTEYNWTTECTKLDD
LFVWWTTPANRDKFGHISHTFTHEEQNNATYNDVKREISFNQAWLRQSGFYDAKYFTSNGIIPPAITGLHNGDALRAWYE
NGITNCVGDNTRTPLLNQQNGMWPYFTTSASDGFDGMQVNPRWATRIYYNCDTPACTVQEWIDTSAGSGDFSNLLATEKA
DTMRHLFGLHRDPYMFHQANLRNVDVDPVEINGETGQWSIMQAWVETMVQEFVRLVDWPIVTITHQEMSANFLDRYNRDQ
CNYSLQYTIGNKQITGVTLSAKDNTCNAPIPVSFPVAPTDTKGFTTEQYGSDPLTVWVQLSGSPVTFSLSTPIPL

BASE SEQUENCE (PUTATIVE) OF NUCLEIC ACID MOLECULE OF Aspergillus sojae agd3

ATGGTTCTACCGTGGTTGCTGAGAACTGGTTGTTACTTCGGACTTATAACTTGCGACACTCCCCCAGGTGTTTGGCCTGA
AGGTATCCCAAGTGTGATCGCTCCTGTGCCTCCCTCACGCACATCTGGAGTCACGACCAACTCTCCCGGCTTTACTTCGT
CGGTCCTGTCGTTCACTTCTTCTTCTTCCCCTCCTGTCACGGGGTCATCGTCTTTCGTTACGATTACTACTACTCTCGCT
TCCTCCACATCCACTTCTACTTCAACCTCTCTACCTTCGTTTACTAGCACACTCGTTTCTGTCAGCACTCCCGTGAGTGC
CTCCAGCACAATGTCTCTAATTCCTTCTCCTTCGTCGAGTCTCATTCCTTGCGCAACACCTTCGGCTTGGGTCATTGCCA
ATGGTAATGTCGCGGGTAACATCTTGGTGATTGCGAAGGACACCGCAGCTGCTAATGTGGCCACCTCGGGCCTCAATGGC
TATGGTATTCCTTTTACTACCTTGCTCGTTCCCCAGTCTGGTGCTACTCTACCAGAGCTGAACGGCACCTCCGGAGGAAA
CTTTGGCGGTATCGTGGTTGCGAGCGAGGTCAGCTACGACTATGGTGCCAAGGCTTCCAGAGCGCTCTGACTACCGACC
AATGGAATCAACTCTATGCCTATCAGCTCGAGTACAGTGTACGCATGGTGCAGTACGACGTGTACCCGGGACCCAACTAC
GGTGCCTCGGCCGTGGGCGGGGGATGCTGTGACTCCGGTGTAGAGCAGCTTGTTTCTTTCTCAGACGTCAGTGACTTTAA
GGAAGCCGGCCTGAAGACCGGTGCCGGTGTCAGTACGACAGGCCTCTGGCACTACCCAGCCTCGGTTAATGATACTGCTA
CCACCAAGGAAATTGCTCGTTTCGCCGCCAACGGTAACTACGGCAGCGAGACCACTGCTGCAGTCATCAACAACTTTAAT
GGCAGACAGCAAATGGCTTTCTTCTTGTCTTTTGACACTACCTGGAGTGCAACTTCCAACTACTTGCAGCACGCATGGAT
CAACTGGCTCACTCGGGGTCTCTACGCTGGCCACCGTCGCGTCAACCTGAACACCCAGATTGATGATATGTTCCTCGAAA
CTGATATCTACTACCCCAATGGAACGACCTTCCGTATTACCACCGCTGATATGGATGGTATCTCGAGCTGGCTCCCGACC
ATCAACGGCAAGATGAACGCCGGTAGCTCATACTTTGTTGAGGTCGGACACAAGGGTAACGGTGTCATCGAATCGGCTAC
CGGGAAGGATGCCGATGCCTGCAACGGAGGTGGCATTGAATACGACTCGCCCGCTGATACTCCTCTGGAGTTCAAGAAGC
CTCTGGGCACCGGTACTGACCTTTGGCCCAAGGACCAGACCGAGTACAACTGGACTACTGAGTGCACCAAGTTGGACGAT
CTTTTCGTCTGGTGGACCACCCCGGCTAACCGCGACAAGTTTGGTCACATCTCTCACACTTTCACTCATGAAGAGCAGAA
CAATGCCACCTACAACGACGTTAAGAGGGAGATCTCTTTCAACCAGGCTTGGTTGAGACAGAGTGGTTTCTATGATGCCA
AGTATTTCACATCCAACGGTATCATCCCTCCCGCCATCACTGGATTGCACAACGGCGACGCCTTGCGGGCCTGGTACGAA
AACGGCATCACCAACTGTGTTGGTGATAACACTCGTACACCGCTCCTCAACCAGCAGAACGGTATGTGGCCTTACTTCAC
TACCTCCGCATCGGATGGATTCGATGGTATGCAGGTGAACCCCCGTTGGGCCACTCGCATCTACTACAACTGTGATACCC
CTGCCTGCACCGTTCAGGAATGGATTGACACCTCCGCCGGCAGCGGCGACTTCAGCAACCTGCTCGCGACCGAGAAGGCC
GACACCATGCGCCATCTCTTCGGTCTTCATCGCGACCCTTACATGTTCCACCAGGCCAATCTTCGCAATGTCGACGTTGA
CCCGGTTGAGATCAACGGCGAGACTGGTCAATGGTCCATCATGCAGGCGTGGGTGGAAACCATGGTGCAGGAGTTCGTGC
GTCTGGTAGACTGGCCCATCGTGACCATCACCCACCAGGAGGTAAGTCATGGAGATCTTAGAAACTCCTCCCAACACCCG
GCAATTGCTAACTAATCACCCCAGATGTCCGCCAACTTCCTCGACCGCTACAACCGTGATCAGTGCAACTACTCGCTGCA
GTACACCATCGGAAACAAGCAGATTACTGGGGTGACTTTGAGCGCCAAGGACAACACCTGCAATGCGCCCATCCCCGTCA
GCTTCCCTGTCGCCCCCACCGACACCAAGGGCTTCACCACCGAACAGTACGGCAGTGACCCACTCACCGTCTGGGTGCAG
CTGTCGGGCTCCCCGGTCACTTTCTCCCTCTCGACTCCTATTCCCTTGTAAATGGATTGAACGATACTGAATTATGGAAG
GGCTTTGAAGGATTCCTGGACCATAATATCTAATGTTATTAATGGGTTTCGTGTAGCGATTTCGAATATGGGAAGAGATG
AATGAAATATTAGGTACATACATACATAGCTACATTGCATACATACTACATA

Fig. 56
PUTATIVE AMINO ACID SEQUENCE OF Aspergillus sojae Gtb3

MAEILHVSALGWDKMKDHWWQFVFIAILIACVATGSLWLLYSGTKRLRNYIKTRPRSEKVPPNVSQRLVTLSNKLLSVPN
IQRRKPSSFGVYLGSFSSPPDRDQLRLLNEWDLLIVDPFQSGTAQAIRYVEGKQLLGRVDLDRILSKDESTLSAIEKIEN
LLTGTFDSANFSGMVLANWEGKFPAPVFTKLVEVIDELGLAVYLETAPPDFLKDHTSMQNPAISGIVIQNASILPEGQKR
DYFQLVKMQPTIKAFVSEACVRDFVVMAWETIDDNASLSNAVVQRSLQWCNFYSAIPWIGQKSALTNAALNVKISEPLSS
FGWLKDAEIIKAHDRWRSNLHLKDDASDTSAWNTLLPFFPTLEELLTSSEYGQPESNELTTKLRDPPEWVAQVKSLGSPL
SISMAGIEYNSLGCFPLGSEATALAFAEVLQSQLRLKSLGLLHPVPASKIQSIGLLLKKFHESYLLPNATSSDPYVIPNA
TSDQLATTIKELSNLATNGSLQVNLGLDSGLRKSVDVRFWAVYQMDSDGFEVFASKKAQGLAGTVLHTFLSAKGYPRHVC
FEVETALAKWSKDLVNDTGLPRRFVEDIDMLSPEERLLLFQHLSLTDSYSELSDTICAYIRRLLIDAPSLAQLKELNTIS
YLEGSASPEILVNTRIKWYREQGCQHPSPSKCLALFYQTDAAFTQILREHREGDLALISKGFCQLLQNDHIDAYTDIMAL
ALFCAARKGAIDEIYTEVTDRNPLFNNQSDQAAAFSESFALGSRCEVYFDVQPSAFGKLLSDRFRREYNDEKLPDWINGA
PEMATSYAGAQIDVNPDDKVKPMPGYQRFTFLGVFAFPALIDIILLTIIGRGLYLSAFMTHDELQSATIALMISLLLSGA
IGTMIACGGPYYLISMAFAASNMFVLIRLIAGVAFTIAAGLIGFIVISGVKSPQAGIIFYLYLVALTIYLTTFATLASFS
YPGTGFLSGRKVIFSCIPILFVSPIITTWSGHDSAIYLAVLYVFIGFLLLGLRSVASKWVTWYQNIRRTDDTEIRKWYIS
TYGNNDEKVFGNMSDPAVLKMSRDALFKDVLAEKSRSFFSKPTTDTLVRELARDWDSTNFLLDWYCRYADVPRPIPFSSS
WNIQTKVGLDVLRNSQKGIRLHNAFIHWRQSSKEIGCGILYFIIALLDKWVELLSGGQLVGLSTSLSDANRMAVGFGLAY
YLIGAVLIDTKAQELHDLVGGQHSAVAVGSAKEIRPSQKRDVRFKRKVYWKTFFKFLMWLVWSLAIATALIWTFQAPVQAM
IMFFAYVLSYTGLLWYQYTKIFTGPHALIPLMTGVVVGLPVGIALKVCLGNNFLYSQVIGLGAATWTVAILSLFTAKMGM
PKKVDSPVELGKTFHAYTAPWADPEWSQQELQTFFEGVSVVPADARLKLVPGSHPGVEVKTILLSRKIEPRIEEAFPESE
KLISMALGAWETGEISLELVPLGSLGPNIQALSCSMSGHLQIAICVGRGLDERIDVSANCQVIAETLLHAVAESMMRMPH
EYAVLSESLVTAGVTETTARQLREEPDTPLVVRWSKKELLRQLCLGFEVDSHWEKLPENVRNMLLDRCLGRPCLLSEGSQ
QWLQTSLCRFDTSDLNVHVARCNLGAATAVSILDYANYGTGEAGAIKDPEIPIYIPEIPKKLPMAMSIIQKPLSYVYHSI
GSGVKFFIAALLADSEFQREFDHVMSERHTLIRVPLVFLLNMVWLYFKTVQDIGLSFFLFHGRSNVKRLWNETKGITVSI
KKSRFVVQSLEGTFTAFRHNEPDGGFKVYYYSGEHKTEPEGMKLLKYVSTYSKDMLLLIRQEFKDGKVLNEYHYDYRAPT
KKSFTLSKAWATRIPLGRRCVRGQNNLQSVQYNRKGLIEAGSYMKDGNLIRFKYHYRKNPRFGDELLRAEFSLTHITCTV
SWCAPPLRHPEKVERWIPHSKVTEATFVQGADVYEARWLYDHKFHPTIFTTLNGGQKVQTPPMIENDFIGVLAKPKQTSFV
NDNPLLYCDSLSSNTVTRFLGLTTKRFPVSTSRARSLLWKSWKDRVDFDAIMVRWLDERLLRREKTLAPYWRARNRGDLA
AAKKYLELRADAITASADLDDNISSWTPLAVKISDLFNFGPGGDAVVHTRSKDFGSDTDKSMHVMAADNGTWPNEGGGVS
ACRRDMINSLRTVKWHMICESANDFGIPKHQTEQNVLSLKVVPLWGLDFLTPTHGLFRNKLDSEVDNVTSASDMDIKLNF
IPILTALVKGARATHLSKADIHQATRALVNLNTYFQDSRHWTQIWNSDIVKESWRDLWLTQEMPNTVPSSQWFRTELPTL
TSLDTALELWYRYLFIFSIPIPEKIPSVFQASHHSVSASYGVVCKMKRNCTLQIWDHAISWRETNLCLSSALCKLSPFVR
NALLGLMRITSALTLHHADIILPCADFFNPGWEVEIGTCQGTIEHRNVFRRKVDPVVNGITDMQKFAPVKEIKSQRPTVT
MLSHVWYAKDIKIALLAADIIINQWKFDDYHLDIYGAIDKAPTYSTECQEIIASKGLRGKVTLRGTADPMKVLENTWLFL
NSSLSEGLPLALGEAALTGAPVVCTDVGASLRVLSDPDDFSRYSAVVAPNDAHALAKAQITMLGLLGEWSKYTDDTEPAP
VLTSSPTPEDVAKITRRMYEKSDYRRKLGMMTRDIVQKSFSGDRYLREHEQMLWIGKSAKIMANRVGGAITEPTDIATAM
RQTLPIEEEVITIPRSAVHSWRSSAASGMSTVYSEVSNFPMLNGYHRPSSIRSGISGMSTDTESFLPLPSNASLPVFAPR
QTLGYPSTPDGRLSPSGRLSPLPNPRNSGRRSMSTAGREQLRGLGREELNPYRNSDVSTIMRDEFLQSSIYKNIEGSNST
PNMI

Fig. 57

BASE SEQUENCE (PUTATIVE) OF NUCLEIC ACID MOLECULE OF Aspergillus sojae gtb3

```
CGGACCTGTGAGGTTGGCCTGCAATATCTAATCAGGATGGCGGAAATCCTCCACGTCTCAGCCCTCGGCTGGGATAAAAT
GAAAGATCATTGGTGGCAGTTTGTAAGTAGTGATTGCATATACGTTTCAAATATCACTGACTAATGCTATGCTAGGTGTT
CATCGCTATCTTAATAGCTTGTGTAGCTACAGGATCCTTGTGGCTCCTGTACTCTGGGACGAAGAGACTGCGCAACTACA
TCAAGGTAGGGCTTCTTTGATATGCTTGTGAATGTATATCTGATCTGTCGCTCACCTGATTCAAATCATAGACAAGGCCA
CGTTCAGAGAAAGTGCCACCCAATGTATCTCAACGGTTGGTTACTCTTTCCAACAAGTTGCTCAGTGTGCCAAACATTCA
AAGACGCAAGCCGTCTTCTTTTGGCGTCTATCTGGGTTCATTCAGTTCCCCGCCAGATCGGGATCAGCTTCGGCTCCTGA
ATGAATGGGACCTGTTGATCGTTGACCCTTTTCAGTCGGGCACGGCCCAAGCAATCCGTTATGTGGAGGGTAAGCAGTTA
TTGGGAAGAGTTGACCTTGATCGTATCCTCTCAAAGGATGAGTCCACATTGTCAGCAATTGAAAAGATTGAAAACCTTCT
CACCCGGCACATTCGATAGTGCTAACTTCAGCGGTATGGTACTGGCCAACTGGGAAGGAAAGTTTCCCGCCCCGGTTTTCA
CTAAGCTTGTTGAGGTGATCGATGAGCTGGGTTTGGCAGTGTACCTGGAGACGGCACCCCCGGACTTTCTAAAGGACCAC
ACCTCCATGCAAAACCCTGCAATTTCCGGAATCGTTATTCAAAATGCCAGTATACTGCCAGAAGGCCAGAAGCGCGACTA
TTTTCAACTCGTGAAGATGCAACCCACCATCAAGGCGTTCGTCTCTGAAGCTTGTGTGAGAGATTTCGTGGTGATGGCGT
GGGAGACAATCGATGACAATGCCTCATTATCGAATGCTGTTGTCCAAAGATCTCTCCAGTGGTGTAACTTTTACAGTGCG
ATCCCATGGATTGGTCAGAAGTCGGCTCTCACAAATGCCGCCCTTAATGTCAAGATCTCAGAGCCTCTCTCCTCTTTTGG
ATGGCTGAAAGATGCCGAAATCATCAAAGCCCACGATCGCTGGCGCTCAAATTTACATCTCAAGGATGATGCATCCGATA
CGAGCGCTTGGAACACATTGTTGCCGTTTTTCCCTACCCTAGAAGAATTGCTTACCTCGTCGGAATATGGTCAGCCTGAG
AGCAACGAGTTGACGACAAAACTCCGCGATCCACCGGAGTGGGTAGCACAGGTAAAATCTCTAGGGAGTCCACTTTCCAT
ATCAATGGCCGGCATTGAATATAACTCTCTTGGTTGCTTCCCGCTTGGATCTGAGGCGACAGCACTTGCTTTTGCCGAAG
TCCTTCAGTCTCAATTGCCGCCTTAAATCACTGGGCTTGCTCCACCCGGTTCCTGCTTCCAAGATTCAGAGCATCGGTCTG
CTCCTCAAGAAATTTCACGAATCTTATTTGCTTCCCAACGCAACCAGCTCAGATCCTTACGTCATTCCAAACGCAACCTC
GGACCAACTGGCGACTACGATCAAGGAACTGTCGAACCCTGGCAACTAACGGCTCATTGCAGGTCAACCTTGGACTGGACT
CAGGACTTCGTAAGAGCGTCGACGTGCGCTTTTGGGCAGTTTATCAGATGGACTCGGATGGTTTTGAAGTTTTTGCTTCG
AAAAAGGCCCAAGGTTTAGCAGGAACTGTACTGCATACATTCTTATCTGCAAAAGGATACCCCCGCCACGTTTGTTTTGA
GGTAGAAACCGCTTTAGCCAAATGGTCTAAGGACCTCGTCAATGATACAGGACTTCCTCGCCGTTTCGTCGAAGACATCG
ACATGCTGAGCCCAGAAGAGCGACTGCTTCTGTTTCAGCATCTCTCCTTGACCGACTCCTACAGTGAGCTCTCCGATACT
ATCTGTGCATACATTCGGAGACTGCTTATCGATGCCGCCTTCACTCGCTCAGCTGAAGGAGCTTAACACGATCTCATATCT
TGAAGGATCGGCTTCTCCCGAAATTTTGGTTAATACCCGCATCAAATGGTACCGAGAACAGGGATGCCAACATCCGTCAC
CATCCAAATGTCTCGCATTATTCTACCAGACGGATGCCGCTTTTACTCAGATCCTAAGGGAGCATCGCGAGGGAGACCTT
GCTTTGATATCAAAGGGCTTCTGCCAGCTGCTTCAAAATGATCACATCGATGCGTATACTGATATCATGGCATTGGCACT
TTTCTGCGCTGCGAGGAAAGGAGCAATCGATGAGATTTATACTGAAGTGACCGATCGTAACCCGTTGTTCAACAATCAAT
CAGACCAAGCGGCTGCTTTCTCAGAATCGTTTGCTTTAGGGTCACGTTGTGAGGTCTACTTTGATGTTCAGCCTAGCGCT
TTTGGAAAGCTGCTCTCGGATCGTTTCAGAAGGGAGTACAACGATGAGAAGCTCCCCGATTGGATCAATGGCGCGGCCTGA
GATGGCCACATCTTATGCGGGTGCCCAAATTGACGTTAACCCGGATGACAAGGTTAAACCGATGCCTGGCTACCAGCGAT
TTACTTTCCTCGGTGTTTTCGCATTCCCAGCATTGATCGACATCATTCTGCTCACAATTATCGGCCGTGGTCTCTACCTT
TCAGCCTTCATGACCCATGACGAGCTACAGAGTGCCACCATCGCTTTGATGATCTCCCTTCTCCTATCTGGTGCAATCGG
TACGATGATTGCCTGTGGAGGACCCTACTATCTCATTTCGATGGCTTTCGCAGCTTCAAACATGTTTGTCCTTATCCGAC
TAATTGCTGGTGTTGCGTTTACAATTGCTGCTGGTTTAATCGGATTCATCGTTATCTCTGGCGTGAAAAGCCCACAGGCT
GGAATTATCTTCTATCTGTACCTAGTCGCCTTGACCATTTACCTGACGACCTTCGCTACCCTCGCTAGCTTTAGTTACCC
TGGAACCGGTTTCTTGTCCGGGCGCAAAGTGATCTTCAGCTGCATCCCCATTCTTTTCGTCTCACCTATCATCACTACTT
GGAGCGGCCACGATTCAGCTATTTACCTCGCTGTGCTATATGTCTTCATCGGGTTTTTGCTTCTCGGCTTGCGATCAGTT
GCCTCTAAATGGGTGACCTGGTATCGAACATCAGGAGGACGGACGATACGGAAATCCGGAAATGGTATATTTCCACGTA
CGGTAATAACGACGAGAAGGTGTTTGGAAACATGAGTGACCCGGCTGTCTTGAAAATGTCAAGAGATGCTCTCTTTAAGG
ATGTCTTGGCTGAGAAGTCCCGGAGCTTCTTCTCTAAGCCCACAACTGATACGCTGGTCGCGAGCTTGCCAGGGACTGG
GATTCGACGAATTTCCTCCTCGACTGGTACTGCCGTTATGCTGATGTGCCTCGGCCGATTCCGTTCAGTTCCTCTTGGAA
TATCCAGACCAAGGTCGGGCTAGACGTTCTTCGGAATTCCCAGAAAGGAATCCGGTTGCATAATGCCTTCATCCATTGGC
GCCAATCGAGCAAAGAAATAGGCTGTGGAATTCGTACTTTATCATAGCCCTCCTGGACAAATGGGTTGAGTTATTGAGC
GGTGGACAACTCGTTGGTCTCTCAACCTCCCTTTCTGATGCCAATCGGATGGCAGTCGGATTTGGATTGGCTTACTACCT
CATTGGGGCCGTTCTCATCGATACCAAGGCCCAGGAACTCCATGATCTTGTGGGCCAGCATTCGGCTGTTGCTGTGGGAT
```

Fig. 58

```
CAGCCAAGGAGATACGTCCGTCCCAAAAGCGAGACGTGAGATTTAAGAGAAAAGTCTACTGGAAGACCTTTTTCAAATTT
CTCATGTGGCTTGTGTGGAGCTTGGCTATTGCAACTGCTTTGATCTGGACTTTCCAAGCACCAGTGCAAGCGATGATCAT
GTTTTTCGCTTATGTATTGTCCTATACCGGCCTGCTTTGGTACCAATATACAAAGATCTTCACCGGCCCGCACGCGCCTCA
TACCGCTGATGACTGGTGTTGTCGTCGGATTGCCTGTCGGTATCGCCCTCAAAGTATGCCTTGGCAATAACTTCTTATAC
TCCCAGGTGATTGGTCTAGGAGCAGCTACATGGACAGTGGCTATTCTATCCCTTTTCACCGCCAAGATGGGCATGCCCAA
GAAAGTTGACTCACCGTGTGGAGCTTGGGAAGACATTCCACGCATATACCGCTCCGTGGGCGGATCCTGAGTGGTCCCAAC
AAGAGTTACAGACATTCTTTGAAGGAGTCTCAGTCGTCCCTGCCGATGCGGCGGTTGAAACTGGTGCCCGGCTCGCATCCT
GGTGTTGAAGTTAAAACTATTCTACTTTCGCGGAAGATAGAACCAAGAATCGAAGAGGCCTTCCCGGAGTCGGAAAAGCT
TATCAGTATGGCCCTGGGTGCCTGGGAAACGGGGCGAAATATCCCTTGAACTTGTGCCACTGGGCTCGCTTGGCCCCAACA
TTCAGGCGTTGAGCTGCAGTATGTCTGGTCATCTGCAGATTGCCATCTGCGTTGGACGAGGACTAGATGAGCGGATTGAT
GTCAGCGCTAACTGCCAGGTCATTGCCGAGACTCTACTCCACGCGGTCGCCGAATCAATGATGCGAATGCCCCACGAGTA
TGCCGTGCTTTCTGAATCGCTTGTTACAGCTGGTGTGACTGAAACGACCGCCAGACAACTCCGGGAGGAACCTGACACTC
CACTCGTCGTACGCTGGTCAAAAAAGGAGCTTCTGCGGCAACTGTGTCTTGGATTTGAGGTTGACTCTCATTGGGAAAAA
CTGCCTGAGAATGTTAGGAACATGTTGTTGGATCGTTGTCTTGGTAGGCCATGTCTACTATCCGAGGGCAGTCAACAATG
GCTTCAAACGAGTCGTTTGTCGGTTTGACACGAGCGGATTTAAATGTGCACGTTGCTCGCTGCAACCTGGGAGCTGCCACTG
CTGTTAGTATCCTTGATTACGCGAATTACGGAACCGGTGAAGCAGGGGCCATCAAGGATCCGGAAATCCCGATATATATC
CCAGAAATTCCGAAGAAGCTTCCTATGGCTATGTCCATCATCCAGAAGCCGTTGAGCTATGTATATCACTCTATTGGCTC
TGGAGTCAAGTTCTTCATCGCTGCTTTACTTGCCGATTCCGAATTCCAGAGGGAATTTGATCATGTCATGAGTGAGCGCC
ACACATTAATTCGGGTGCCGCTTGTGTTTTTGTTGAACATGGTTTGGCTGTATTTCAAAACGGTGCAAGATATTGGTTTG
TCATTTTTCTTATTCCATGGCCGGTCCAACGTGAAGCGGCTGTGGAACGAAACCAAGGGCATTACCGTCAGCATCAAAAA
GAGTCGCTTTGTTGTGCAGAGCTTGGAAGGTACCTTCACTGCTTTTAGGCACAACGAGCCCGATGGCGGCTTCAAGGTGT
ACTATTACTCGGGAGAGCACAAGACAGAGCCAGAGGGCATGAAGCTTCTCAAATATGTCAGCACATATTCAAAGGATATG
CTTCTGCTCATTCGCCAAGAGTTCAAGGACGGCAAGGTGCTCAACGAGTACCACTATGACTACCGCGCTCCAACAAAGAA
AAGCTTTACCCTATCCAAGGCGTGGGCGACCAGAATCCCCTTGGGTCGGCGTTGCGTACGCGGACAAAACAACTTGCAAA
GTGTTCAGTACAACCGCAAAGGTCTCATCGAAGCGGGCTCCTACATGAAGGATGGAAATCTTATTCGCTTCAAATATCAT
TACCGCAAGAACCCTCGCTTCGGTGATGAGCTGTTGCGCGCTGAGTTTTCGTTGACACATATCACTTGCACAGTTTCCTG
GTGCGCGCCTCCCCTTCGCCATCCGGAAAAGGTTGAGCGTTGGATCCCTCATTCTAAGGTCACCGAAGCGACGTTTGTCC
AAGGAGCTGATGTCTACGAGGCTCGTTGGCTGTACGATCACAAGTTCCATCCCACAATTTTCACGACGCTTAATGGACAG
AAGGTGCAGACACCTCCGATGATCGAAAACGACTTCATAGGAGTGCTCGCCAAACCTAAACAAACCAGCTTTGTGAACGA
TAACCCTCTTCTATACTGCGACAGCCTCAGCTCGAACACTGTTACCCGTTTCCTAGGGCTAACAACTAAGCGCTTCCCTG
TATCCACTTCTCGTGCTCGTTCATTGCTATGGAAGTCTTGGAAAGACCGCGTAGACTTTGATGCAATTATGGTCCGTTGG
TTGGATGAGCGGCTCCTGCGAAGAGAAAAGACCCTGGCTCCCTACTGGCGTGCTCGTAATCGTGGTGATCTGGCAGCGGC
GAAGAAATATCTTGAACTCCGCGCGGACGCCATCACCGCCAGCGCTGATTTGGATGACAACATCTCCAGCTGGACCCCTC
TTGCGGTGAAGATTAGCGATCTTTTTAACTTCGGACCCGGAGGTGATGCGGTGGTCCACCACGATCGAAGGACTTCGGC
TCTGATACTGACAAGTCGATGCATGTCATGGCTGCTGATAATGGTACTTGGCCGAACGAAGGAGGCGGTGTCTCTGCCTG
TCGACGTGATATGATTAACTCGCTAAGGACAGTCAAGTGGCATATGATTTGCGAATCAGCAAATGACTTTGGTATTCCCA
AGCACCAGACGGAGCAAAATGTCCTTTCGTTGAAAGTGGTTCCTCTTTGGGGCTTAGACTTCCTCACTCCAACACATGGG
CTTTTCAGGAACAAACTCGGACTCGGGAAGTTGATAATGTTACATCCGCCAGTGACATGGATATCAAGCTTAACTTCATCCC
AATTCTGACTGCTCTGGTGAAGGGAGCGCGTGCGACTCACCTTTCAAAGGCTGATATCCACCAGGCGACCGGCGTTTGG
TCAACTTGAACACATACTTCCAGGACTCGCGGCATTGGACTCAGATCTGGAACAGCGATATTGTCAAAGAAAGCTGGAGA
GACCTTTGGCTTACTCAAGAGATGCCTAATACCGTTCCATCATCCCAGTGGTTCCGCACCGAACTTCCAACCCTAACGTC
ACTTGATACTGCCTTGGAACTTTGGTATCGGTATCTCTTCATTTTCTCCATTCCAATTCCTGAGAAGATACCCAGCGTCT
TTCAAGCATCGCATCACAGTGTTAGCGCGTCCTACGGGGTTGTATGCAAGATGAAGAGAAACTGCACCTTGCAGATTTGG
GACCCACGCCATTAGTTGGCGTGAAACGAACCTCTGCCTGTCGTCCGCCCTGTGCAAGCTTTCTCCATTCGTTCGCAATGC
TCTCTTAGGTTTAATGCGCATCACTTCAGCTCTTACTTTGCATCATGCCGATATCATTCTTCCTTGCGCTGATTTCTTCA
ATCCAGGCTGGGAGGTTGAAATTGGTACCTGCCAAGGAACCATTGAACATCGCAATGTTTTCCGCAGGAAGGTCGACCCC
GTTGTCAATGGTATCACTGACATGCAAAAGTTCGGCCCCTGTGAAGGAGATCAAGTCTCAGCGCCCGACAGTCACCATGTT
GTCGCACGTGTGGTATGCCAAGGATATCAAGATAGCTCTGCTTGCCGCCGACATCATTATCAACCAGTGGAAGTTTGATG
ATTATCACCTGGATATTTATGGGGCCATCGACAAGGCGCCAACATACTCTACTGAATGTCAAGAAATCATCGCCTCCAAG
GGTCTCCGAGGCAAGGTTACTCTCCGTGGTACGGCAGATCCGATGAAGGTGCTCGAGAACACCTGGCTTTTCCTCAATTC
```

Fig. 59

```
GTCACTTTCCGAAGGTCTGCCCTTAGCCCTAGGTGAAGCTGCTTTGACCGGTGCCCCCGTGGTTTGTACCGATGTCGGTG
CATCTCTTCGTGTTCTGAGCGACCCAGACGACTTCTCTCGTTACAGTGCCGTCGTCGCACCCAATGACGCTCACGCCCTC
GCAAAAGCGCAGATCACCATGCTTGGCCTTCTGGGAGAATGGAGCAAGTATACTGATGACACTGAGCCGGCACCTGTGCT
CACTTCATCTCCAACACCAGAGGACGTTGCCAAGATCACCCGCCGCATGTATGAGAAGAGCGATTACCGCCGCAAACTCG
GCATGATGACCCGCGATATCGTCCAGAAATCATTCAGTGGCGACCGATACCTCCGTGAGCACGAGCAGATGCTGTGGATC
GGCAAGTCTGCCAAGATCATGGCCAACCGTGTTGGAGGAGCCATCACTGAGCCCACAGACATCGCAACAGCCATGCGCCA
GACTCTCCCGATTGAAGAAGAAGTCATCACCATCCCTCGCAGCGCCGTGCACTCGTGGCGTTCGTCTGCTGCATCGGGCA
TGTCGACAGTATACAGTGAGGTTTCCAATTTCCCAATGCTCAATGGCTACCACCGTCCATCCTCTATTCGCTCAGGTATA
AGCGGTATGTCAACGGATACAGAGTCTTTCCTTCCTCTCCCCAGCAACGCCTCCCTCCCTGTCTTCGCGCCTCGTCAGAC
CCTGGGCTACCCCAGCACCCCTGACGGTCGTCTCTCACCTTCGGGGCGTCTCTCACCGCTACCAAACCCGAGGAACAGTG
GCCGACGATCCATGTCAACCGCTGGCCGCGAGCAGCTACGTGGTCTCGGACGCGAAGAATTGAACCCTTACCGCAATTCC
GACGTCAGTACCATCATGAGAGACGAATTTCTTCAATCAAGCATCTACAAGAATATAGAAGGCAGCAACAGCACCCCCAA
CATGATCTAAAACGAAAAAGGAAAAGAAAAAGAAAAATCCCATCTAGTTCTCTTGGTTTTGCATCTCCTTTTTTAATTTT
AATTTTTCATTTTTTTGCATACTATATGACTGATTTTTGGGTTATACTCCCGGCCCTGGCAATAATTGCTAATCTGTCAT
TGTCTATACCAACCATATACCCCGAGATGATGAAGTGCTCGTTGTAAATACCTGCATCTTGCATATACTTTCCCTTATTT
TGCATCTAACTTCATCATTA
```

Fig. 60
PUTATIVE AMINO ACID SEQUENCE OF Aspergillus niger Uge3

MESPRQSDASTPVEPCSPGCVDTPATQSSVLFDGNLEELLRNFPLDQYILVTGGLGFIGSHTTLELLKAGYNVIVIDNLS
NSFQSVFDRIRQLAAKYHDQEGTCMPSLQLHAHDFRDIAALRGLLEQYQIQSRWGTPKSRIGGVIHFAAYKAVEESIRNP
LKYYANNVSGLIDFATTLGEFGIKTFIFSSSATVYGTLATSGLPLKEELCVHKEEVYSDQDGLEQTVKPGCTGITNPYGR
TKWICEAILADLAASDPEWTIVALRYFNPIGCDESGLLGEDPRQTPTNLLPVVVKVMTGQYKELQMFGTDWDTEDGTAVR
DFIHVTDLARGHIAALNAANGGKLVENFRTFNLGTGRGHSVMEVVNTMEAVSSKPIPRKAAGRRAGDVGSCVAVATRSQD
ELEWKTEKSLKDACVSLCNFLNVSGLSS

BASE SEQUENCE OF NUCLEIC ACID MOLECULE OF Aspergillus niger uge3

GTTGCTCGTTTTGAGGAAAATATAAGATTTGGGAAACTCCTTTCCTTGGGTTATCCCGTCCAGAGTCAAGTCACCTGCGG
TCGTTAAATTCTCGTTGGAGAATAAATCTTTCTGTCCTTTCCTTGTTTTTGTTTGTCCAAGTGATTCCTGTCCGCATTGC
CCCCCAACGGTGCCTCATCCTTCGACCCTATCAGTTATGGAGAGCCCTCGACAGTCCGATGCAAGCACTCCTGTGGAGCC
TTGCTCCCTGGTTGCGTTGACACGCCGGCGACGCAATCTTCCGTGTTGTTTGATGGCAACCTTGAAGAGTTGCTGCGCA
ACTTTCCCCTCGATCAGTACATCCTCGTCACAGGGGGTCTCGGGTTCATCGGCAGTCACACAACATTGGAGCTACTCAAA
GCCGGCTATAATGTAATTGTGATCGACAATCTCAGCAACTCTTTCCAGAGCGTCTTCGACCGCATCAGACAACTGGCCGC
AAAGTACCATGACCAGGAGGGGACATGCATGCCGTCATTGCAGCTCCACGCCCATGATTTCCGGGATATTGCTGCTCTTA
GAGGCCTTCTTGAGCAGTATCAGATCCAATCCAGATGGGGAACTCCCAAGTCCAGAATTGGTGGCGTCATCCACTTTGCT
GCTTATAAGGCTGTGGAAGAGAGTATCAGGAACCCCTTGAAGTATTACGCGAACAATGTTAGTGGTCTTATCGACTTTGC
CACAACTTTGGGAGAATTTGGAATTAAAACATTCATTTTCTCCTCCTCCGCCACGGTGTACGGAACCTTGGCAACTTCGG
GTCTTCCCTTAAAGGAAGAACTCTGTGTCCATAAAGAAGAGGTCTACAGTGACCAAGACGGTCTGGAACAGACCGTTAAA
CCTGGCTGCACGGGTATTACGAACCCGTATGGGCGCACCAAATGGATCTGCGAAGCCATATTAGCGGACCTTGCGGCTTC
TGATCCAGAATGGACCATTGTAGCCCTACGCTATTTCAACCCTATAGGATGTGACGAATCTGGCCTTTTGGGAGAGGATC
CCAGGCAGACGCCCACGAACCTTCTCCCGGTTGTGGTAAAAGTCATGACCGGACAATATAAGGAGCTGCAGATGTTTGGC
ACGGACTGGGACACTGAGGATGGCACTGCAGTTCGCGATTTCATCCATGTCACCGATCTTGCTAGGGGACATATTGCTGC
GCTCAACGCCGCCAACGGTGGAAAGCTGGTTGAGAACTTTCGTACCTTCAACCTGGGCACCGGACGGGGTCACTCTGTGA
TGGAGGTGGTCAACACAATGGAAGCAGTGTCTTCCAAACCTATTCCCAGAAAAGCTGCAGGTCGTCGCGCTGGAGATGTT
GGCTCTTGCGTCGCTGTCGCCACAAGATCCCAGGACGAGCTCGAATGGAAGACCGAAAAATCTCTGAAGGATGCTTGCGT
GAGCCTATGCAATTTCCTCAATGTCAGCGGCCTGTCCTCTTAG

Fig. 61
PUTATIVE AMINO ACID SEQUENCE OF Aspergillus niger Sph3

MGQGEHVRDRRCLQSRRSRLILAILVFIALLAVVIPPAVVLTLHKFTMGPKASVFVPLYVYPAPGAWDPLEKVISSHPDV
NFTVVVNPGSGPGPNALPDGNYTREIPKLASYGNVRLLGYVATTYGQRNFSLVRRDIETYAAWPTNSSNPNLAVRGIFFD
ETPQQYESNTLAYLQDLTAVVKTTTGLGPDHFVVHNPGTIPDARYLPTADSTVVFEATYETFLERQGAKLFQEIPNSTRS
QLCAVVHSVPDSVEGHKFRDLVKQVRKVADEIFITHLDTDYYASFGGQWEEFVELMARS

BASE SEQUENCE OF NUCLEIC ACID MOLECULE OF Aspergillus niger sph3

ATGGGGCAGGGTGAACACGTGAGAGACCGGCGCTGCCTGCAAAGCCGGCGCTCGCGACTCATTCTGGCAATCCTTGTATT
CATTGCCCTTCTCGCCGTCGTCATACCACCAGCAGTAGTGTTGACCCTACACAAATTCACCATGGGCCCTAAAGCATCAG
TTTTCGTACCGCTCTACGTCTACCCTGCCCCGGGAGCATGGGATCCCTTAGAAAAGGTGTAGGTGCTTTTTTCCTTTTGT
TATCCCCTTCTCCATATCTCAACAAGCCCTCGCCAAATGTTAACCCCCCTCCCCCTTCCCCTTCCCCCCGCCAACCACAT
TGTACTCCAGTCCATGCCCACGCTATCTGTCAGCCACCGGATGTCCCGCGGCACGATACAAGTAACCCTGATGTACGAAG
GACGCAGCTGAACGCCACAGGATCTCTTCTCATCCCGACGTCAATTTCACCGTCGTGGTCAATCCTGGTAGTGGTCCAGG
GCCCAACGCCTTGCCCGATGGAAATTACACACGAGAGATACCCAAGCTGGCGTCTTATGGCAACGTCCGCCTCCTAGGCT
ATGTTGCTACCACGTACGGGCAGCGCAACTTCTCGTTGGTGCGGCGGGACATTGAGACCTATGCGGCGTGGCCGACCAAC
AGTTCGAACCCCAATCTAGCGGTTCGGGGTATATTTTTCGACGAAACCCCCCAGCAATACGAAAGCAATACCTTGGCCTA
CCTCCAAGATCTGACTGCTGTCGTGAAGACAACCACCGGCCTGGGTCCGGACCATTTTGTACGTGCAGAAGTCTCTCCCG
TATTTTCATTCTTTCATTACTAGGGGTAACGCCGGGTAATTTACACCATTACCAAATTTCGGCAGCTGGCATTTCCGCCC
ACTCGCTCATTGCCTTTTGCTGCCCCCTCAAACGCATGGTTCTTTTTCTCTTTGCTTTTTTTGGATGCTTCTGTTCTGGC
TCCTGTTCCTGCCGACAATCCTCATCCAGAGCCGTCGTTTGGATCGCCCGGATAGATCTGGATGGACGCCCACCATTGGC
CCGAGTTTACCATGCTAACGAGACTGTCTCAACTAGGTCGTCCATAATCCCGGCACGATCCCTGATGCCCGCTACTTGCC
GACGGCTGATTCGACTGTGGTCTTTGAGGCAACCTACGAGACGTTCTTGGAGCGTCAAGGGGCTAAGCTGTTTCAGGAAA
TCCCGAACAGCACTCGCAGCCAGCTGTGCGCCGTGGTCCACTCGGTGCCAGACAGCGTGGAAGGGCACAAGTTCCGAGAC
CTGGTGAAGCAAGTGCGCAAGGTCGCCGATGAGATTTTCATCACTCATCTGGATACAGATTATTATGCGAGTTTTGGCGG
CCAATGGGAGGAATTTGTGGAACTAATGGCTCGATCGTGA

Fig. 62
PUTATIVE AMINO ACID SEQUENCE OF Aspergillus niger Ega3

MEPASEAALKGPPSRGWKTWTFKKKLIIIGGIIGFIIALGIGLGVGLGVGLGGGGGGGEEEGGGGETTPPSSGNYTSAKW
QPAVGTSWQIELLYPLNDTSVDVDVYDIDLFNNNKSVINDLQKAGRKVICYFSAGSYENWRPDKDKFNSDDLGKNLDGWP
GEKWINISSPRIRKIMLTRLDLAQNKSCDGVDPDNVDGYDNDNGLDLTEADSISYMNWMANEAHARNMSIGLKNAGSIIS
SVIKNMQWSVNEQCSQYDECDTYAAFTEAGKPVFHIEYPKGDDTNNDLSVTSSQKSKACNFTDSGNFSTVIKNMDLDNWI
EMC

BASE SEQUENCE OF NUCLEIC ACID MOLECULE OF Aspergillus niger ega3

GCAACGCCAAGGGTTATACACACCCCCAGCGCCAAGTCGGCATAGTCGAGTCGACGAGCTTGTCCTCTATCCCAGGATCA
CCGTGTTTCAAGCTGTTCACTAGCTCCGAAGCCGGAGGTTCCATGGTTGGAGGTGGAGATGGCTCTGGTGTTTCGAGCAT
CGAACAACCGTGGAAGCTCCTGAAGAAATCGCAATCTCTGGGTCCCTATTTTGTGGACTGAGCACGGTCGCATCTTAGCG
ATCTCTGTTTATTTTCCGCTTAACTCTTTTGGTAAGCGACCCAAGACTGAGTTAGACTGGAAATCAGTCACTAAGGGCAT
CCGGCCGAACCCGGTTTGTCCACCAGTCGACGTGAAGCATCCAACGCCAAGTTGGTGAACGGACAAGACACCGGCGGCTT
GGTGGTTTTGATTCTTGGCCAGTTAGGCCCCCGAATTTTCGCCTCTTTGTCTTCCGGCGTTTCCCCTCTCGTCGACTACC
CATTCAATTTAGGGCAGGGTTGCACAGCTAATGAGCGTGGCGGGAACGATTTGCAGGGTCCAGCTGGTTCCCTTCAGGGT
CCGACTCTCTCACCACCTCACCACACTGCCTATCATCATCACCAACTTGACGCCCCTTCAGTTTCGCTCATTTGGCAAGC
TGTTTCGGACGGCGTGCTGCAATATGAACCGCAGATCCGTGTGACCAGTGAAGCTTCTTTGACTTCGTCTTCAGGCAACT
TCATTTCCTCAAGCTGCAATCGCCGTGGTTTTGACAGGCAAGTCCCGGTCTAGACTCAACTGGTGACTGTTTCTTTGCAT
TGCGCTCCACCTTTTATTCCCCGTAGCCCCGGATCTTCTTGTTTCGTCGCGAGGTTTGTTCTTTTTTCGCGATTCCTCCT
TTGCTCTCACTCGTGTGAAATCTGTTCTACGCGATGGAGCCTGCCAGTGAGGCCGCCCTCAAGGGCCCTCCCTCGCGGGG
ATGGAAGACATGGACATTCAAGAAGAAGCTCATCATCATTGGAGGAATCATCGGGTTTATCATCGCCCTGGGCATCGGTC
TTGGAGTCGGACTGGGTGTTGGACTCGGCGGCGGAGGGGGAGGAGGAGAGGAAGAGGGAGGAGGCGGGGAGACGACGCCA
CCCAGTTCAGGCAATTACACCTCAGCCAAATGGCAGCCCGCCGTCGGCACCAGTTGGCAGATCGAGTTGCTCTATCCTCT
GAATGACACCTCCGTCGACGTGGATGTCTACGACATTGATCTGTTCAACAACAACAAGTCTGTAATCAACGATCTGCAAA
AAGCAGGCCGTAAAGTCATTTGCTACTTCTCCGCCGGCAGCTACGAGAACTGGCGCCCGGACAAGGACAAATTCAACTCG
GATGATCTGGGTAAAAACCTGGACGGATGGCCCGGCGAGAAATGGATCAACATCAGCTCTCCTCGCATTCGAAAGATCAT
GCTCACCCGCCTGGACCTGGCTCAGAACAAGAGCTGCGACGGGGTGGACCCGGATAACGTCGACGGTTACGACAATGATA
ACGGGCTGGATCTGACAGAGGCCGATTCGATCAGCTACATGAACTGGATGGCCAATGAAGCGCATGCGCGCAACATGTCC
ATCGGTCTGAAGAATGCGGGTTCCATCATCTCGTCGGTTATCAAGAATATGCAGTGGAGCGTCAACGAGCAATGCTCGCA
GTACGACGAGTGCGATACCTACGCTGCCTTCACGGAGGCAGGGAAGCCAGTCTTCCACATCGAATACCCCAAGGGTGACG
ACACCAACAATGACTTGTCAGTGACCTCGAGTCAGAAGTCCAAGGCGTGCAACTTCACCGACTCGGGCAACTTCTCCACG
GTGATCAAGAACATGGACCTGGACAATTGGATCGAGATGTGCTAG

Fig. 63

PUTATIVE AMINO ACID SEQUENCE OF Aspergillus niger Agd3

MNSLKSSITSLNCFLGFITCTTPPGIWPKNPTVLTSASTASATSVAEVTRPTTPGTTSAVHSLTTTTTASLVSFLSSTSS
AASTFVTSVGSPTTFVDTSASGSASALSSSTTTTMSVSLSLSSSIVASSAVPAATPVSSGSIAADILVIARDTASAGVAS
SGLNAYGIPFTTLIVPQSGTSLPALNGTEGGNFGGIVVASEVSYNYGNATGYQSALTTDQWNQLYAYQLAYGVRMVQYDV
YPGPSYGASAAGDGCCATGVEQLMSFTDISDFPTSGLKTGAGVSTTGLWHYPATVTNTTTTKEIARFAANSDSGSETTAA
VINNFNGREQMAFFISFDTTWSATSTYLQHAWIPWLTRGLYAGYRRVNLNTQIDDMFLETDIYKPNGTTFRITPADLDGI
ANWLPEINGKMNAGSNYYVEVGHNGNGNIEAAAGVSDEGYTTCNEGGIEYNSPADTPLEWKKPLGTGTNLWPSSPTTYDW
STACTQFDPLLLWWTNTTNQDKFGHISHTFTHEEQDNATYSDVYKEISFNQAWLKQVGISSAKHFTANGIIPPAITGLHN
GDALRAWWENGITNCVGDNTRPALLNQQNDMWPYWTNEDSDGFAGMQVNPRFATRIYYNCDTPDCTLQEWIDTSAGSGDF
DNLLATEKGEVMRHLFGLHHDPYMFHQANLRNADVTPITVNGVTAQYSIFQAWVETQVQEFVRLVDWPLVTINHEDMSAS
FLARYTRDACNYSLRYTISDHKITGATVSATDNTCNATIPVTFPVAPTNTQSFTTEQVGSDPLTVWVQLSGSPVSFTLST
PIAL

BASE SEQUENCE OF NUCLEIC ACID MOLECULE OF Aspergillus niger agd3

ATGAATTCCCTCAAATCGTCGATCACCAGTCTCAACTGCTTTCTGGGCTTTATAACATGCACCACGCCCCCGGGGATTTG
GCCTAAGAACCCGACGGTTCTAACCAGCGCATCTACTGCCTCAGCTACTTCTGTCGCTGAAGTCACCAGGCCCACCACTC
CTGGTACTACTTCAGCTGTCCATTCGTTGACTACCACGACTACTGCTTCTCTCGTTTCCTTCTTGTCCAGTACTAGCTCT
GCCGCGTCCACCTTTGTGACCTCGGTGGGCTCTCCTACCACATTCGTTGATACCTCTGCCAGTGGGTCTGCCAGCGCCCT
AAGCAGCAGCACTACCACCACTATGTCTGTCAGTCTGAGTCTCAGTTCGAGCATTGTGGCCTCGTCTGCTGTTCCGGCAG
CGACGCCCGTCAGCAGCGGCTCCATTGCCGCCGACATCCTGGTGATTGCACGCGACACTGCCTCGGCAGGCGTGGCATCA
TCCGGTCTCAATGCCTATGGCATTCCCTTCACCACTCTGATTGTGCCCCAGTCCGGCACCAGCCTCCCGGCCCTGAACGG
CACGGAGGGTGGCAACTTCGGCGGTATTGTGGTTGCCAGCGAAGTCAGCTACAACTATGGCAATGCCACAGGGTACCAGA
GTGCCCTAACCACGGACCAATGGAACCAGCTGTACGCCTACCAGCTGGCCTACGGGGTGCGCATGGTGCAGTACGACGTG
TATCCGGGCCCGAGTTACGGCGCCAGCGCTGCCGGCGACGGCTGCTGTGCCACCGGGGTCGAACAGTTGATGTCGTTCAC
GGACATCAGCGACTTTCCCACGTCGGGCCTGAAGACCGGTGCGGGCGTGAGCACCACTGGCCTCTGGCACTATCCTGCCA
CTGTCACCAACACCACCACCACCAAAGAAATCGCTCGTTTTGCCGCCAACTCCGACTCGGGCAGCGAGACCACCGCTGCC
GTGATCAACAACTTCAATGGCCGTGAGCAAATGGCCTTCTTCATCTCCTTCGATACTACCTGGAGCGCCACCTCCACGTA
CCTGCAGCACGCATGGATTCCCTGGCTCACCCGCGGTCTGTACGCGGGTTACCGCCGCGTGAACCTGAACACGCAGATCG
ACGACATGTTCCTGGAAACCGACATCTACAAGCCCAATGGCACCACTTTCCGCATCACCCCGGCCGACCTGGACGGCATT
GCTAACTGGCTGCCGGAAATTAACGGCAAGATGAACGCCGGCAGCAACTACTACGTCGAAGTCGGCCACAACGGCAACGG
CAACATTGAAGCCGCCGCCGGGGTCTCGGACGAGGGCTACACCACCTGCAACGAGGGCGGCATCGAGTACAACTCGCCCG
CCGACACTCCCCTGGAATGGAAGAAGCCTCTGGGAACCGGCACCAACCTCTGGCCCTCCTCTCCCACTACCTACGACTGG
AGCACCGCCTGCACACAGTTCGACCCTCTCCTGCTCTGGTGGACCAACACCACCAACCAGGACAAGTTCGGTCACATCTC
CCACACCTTCACCCACGAGGAGGAAGACAATGCCACCTACTCTGATGTGTACAAGGAAATCTCGTTCAACCAGGCCTGGC
TGAAACAGGTTGGCATCTCCTCCGCCAAGCACTTCACTGCCAACGGCATCATCCCTCCCGCCATCACGGGCCTGCACAAC
GGCGACGCCCTGCGCGCCTGGTGGGAAAACGGAATCACCAACTGCGTGGGTGATAACACGCGCCCTGCCCTCCTGAACCA
GCAGAACGACATGTGGCCCTACTGGACCAACGAAGACTCCGACGGTTTCGCCGGTATGCAGGTCAACCCGCGTTTCGCCA
CCCGCATCTACTACAACTGCGATACCCCGGACTGCACGCTGCAGGAGTGGATCGACACGTCCGCTGGCTCCGGTGACTTT
GACAACCTGCTCGCTACGGAGAAGGGGGAGGTCATGCGTCACTTGTTCGGTCTGCACCATGACCCCTACATGTTCCATCA
GGCCAATCTGCGTAATGCAGATGTGACCCCCATCACGGTCAACGGCGTGACGGCCCAGTACTCCATCTTCCAGGCGTGGG
TGGAGACCCAGGTGCAGGAGTTTGTGCGCTTGGTTGATTGGCCGCTTGTTACCATCAACCATGAAGATGTACGCCAATAT
AGCCCCCCTATTACCACTCCAACTGAACCCACTTATTATGAATGCTAATAATATGAATAGATGTCCGCCTCCTTCCTGGC
CCGCTACACCCGCGACGCCTGCAACTACTCCCTGCGCTACACCATCTCCGACCACAAGATCACGGGCGCCACGGTCTCCG
CGACAGATAACACCTGCAATGCTACCATCCCCGTTACCTTCCCTGTGGCGCCGACCAACACGCAGAGCTTCACGACCGAG
CAGGTCGGAAGTGATCCGTTGACGGTGTGGGTGCAGTTGTCGGGGTCGCCGGTCAGCTTTACGCTGTCGACGCCAATTGC
GCTGTAAGAGAGGGGGGGAGTTTCTAGATGTTCATAAAATGTGTAATGGATATATTAGATACTAGTCAGTGACTACGTGG
GTATGATTATATTGAGTCTGAATATATTAGTTAGTTAGTGAGATGGGATGAATACGGCTATGACATAAATACAACAAAAT
AACTGGGTATTAAGC

Fig. 64
PUTATIVE AMINO ACID SEQUENCE OF Aspergillus niger Gtb3

```
MVEILDVSPVGWVFMKEFWWQYVLIAILLASVVCGCSYLTYSGTRRAIRWYKTRPRVEIVPAAVSQRLEKIANQQLTLAA
AHHTKRKPTSVGVYLGTFATPLDETHRQLLDRYDLLIVDPSKSGVVHAILHTDGKQVLGRVDLALSSSQQDLTLAAIEQI
DSALAGSFHGSAFSGIVLANWEDKFKPKVLAKLAEAIHGLGLAVYLETGPPTFLEDGQSLQTPAISGLVVRNASILPDGQ
KRDYFQLDKLRPTIKAFVSEACMRDFLVLAWETVDDDVTLSNAVVQRSMQWCNFYSAIPWIGRKAALENAAINVKTPEPL
SSFSWLKDAETMKAHDRWRTNLDIARNYVAKASWDTLRAYFPSVDDLLFSSEHSPTIKNPPANKLREPPEWVAQVKSQGS
PLSISMAGVEYKELGCFPLGSEATPVAFAEIVHSQQRLKSLNLLHPVPSSKLQNMGLLFRQFYENFALSSWMASDQLAAS
IKELSNMAANDTLRVHLGLDSGLRKSADVRFWAVYQMDADGFDVFASKNAQGLAGTVLHTFLSAKGYPRHVCFEAEIALA
RWSKDINEDIGLPRRIIQDIDALSPEERLLLLQHLSLTDAKGDLSETMCAYIRRQLVDAPTLAQLKELNTVAYLEGSASP
ELLIETRINWYKEQGCQYPSAASSLALFYEAESVFTKVLRERREDDLAQISSGLGQLVQDGPIDAYTDVLVLSLFCAARK
GALDEIYAEVTDRNPLFNNQSDQAAAFAESFALGSRCEAYFDVSPSAFGKLLSDRFRKSYNDEKLPDWIHGAPDMATSYA
GAQIDVDATHKVKPMRGYQRFTFLSVFAFPALIDIILLTIIGRGLYLSAFMTAEEQQSATIALMISLLLSGAIGTWIACG
GPYYLISMAFAAANMFVLIRLIAGIAFTVAGGLIGFICISAAVSPRAGIIFYLYLIALTLYFSCFASLASFSYPGSTFLS
GRKVIFACVPILFVSPIVTTFTGHDSAIYLAVIYAFIGLLLLGLRSVSSKWVTWYQSIRRTDDTEIRKWYVATYGNNDEK
VFGNLSDPAVLKLSREALFKDVLAETKRWFYQKPTTDKLVLELAKDWEATNFLLDWYCRYADVPRPIPFSSSWNIQTKVG
LEVLRNSQKGIRLHNAFIQWRQSSREIGCGVLYFLLALLDKWVELLTGGQMTGLAPSVTSSQRMAVGFGLAYYLIGAVLI
DTKAQELHDLVGKQTTLAVPNAKDIRLAQKRDVKYKRMVYWRTLFKYLGWHVWSLALATALIWTFQDTMEAMIIFVAYIL
AYTGLLWYQYTKIFSGPHAFKTLLIGCVVGLPVGIALKTRLPHFLYSEVIGLGSATWTVAILTLFKAKMGMPKKVSSPVE
LGRVFHAYSSPWSDPEWSQQELQTFYEKLSLVPSDARLSLSPQAHPGVEVKEILLSRRKETRIEEAFPKSDDLVNLALGA
WGKGEISLELVPVGSLGPGIHALSCCTSGQLHIAICVGRGLDQRIDVSANCQVIAETLLHAVAESMLHMPHEHAVLAESL
VTAGVTETMARQLRAEPNTPVVIRWAKKELLQQLCLGFDCDSHWEKLPKDVRQALINRCLGQPCQLSEASRQWLEGRLCQ
FDADTLDVHVARSNLGAASAVSILDYAHYGTGEAATFNDPETPEHIPYVPKKLPSIIQMLAKPWNTIYYAFASVVKFIVV
ALVADPEFQREFDHVIGQHHAIIRVPATLALSLLWSYSRIMQNIGLSFFLFHGRDNVKQLWNEAKGMTISIQKSRFIIQS
LDGTFTAFKHDETDGGFKIYYYSGQHKTEPEGTKSLSYVCVYSKDVLLMVRQEFKGGKLLNEYHYDYRAPTKKAFGLSKS
SQARIPMGRRCVRGDNHLQSVQYNRKGLIEAGSYXXXXXXXXXXXXXXXXXYRKNPRFGDELLRAEFALSHITCTVSWCAP
PLRHPEKIDRWIPHSKVTEATFVQGADVYEARWLYDHKFHPTIFTTLNGQKVQTPPMMEHDYLGVLAKPKHTSFVHDNPL
LYCDSLNSSIFSRFFGLTKKRFPVSTSRARSLIWKAWKERVDFDGVIVRWMDERLLRRDKTLAPYWRSRDRGDLASAKKY
LDVRADTITASADLDDNISSWTPLAVKISDLFNFGPGGDAVVNTRSKDFGADTEKSLHVMAADNGTWPNEGGGVSACRRD
MINSLRTIKWHMICESANDFGIPKHQTEQNILSLKVVPLWGLDFLTPTHGLFRNKLDSEVENVTSASEMDIKMNFIPILT
ALVKGARAIHLSKADIQQATRALVNLNTYFQDSRHWTQVWDSEIVKESWRDLWLSQEMPNTVPSSEWFRTELPTLASLDI
ALELWYRYLFIFSIPIPEKIPNVFQASHHSVSASYGVVCKVKRNCTLQIWDHAISWRETNLCLSSALCKLSPFVRNSLLG
LMRVTSVLTLHHADIISPCADFFNPGWEVEIGTCQGTIEHRNVFRRKVDPVVNGITDMQKFAPVKEIKSQRPTVTMLSHV
WYAKDIEIALLAADIIINQWKFDDYHLDIYGAIDKAPTYSTECQEIIASKGLRGKVTLRGTADPMKVLENTWLFLNSSLS
EGLPLALGEAALTGAPVVCTDVGASLRVLSDPDDFSRFSAVVAPNDALALAKAQITMLGLLGEWSKYAEDDAPPPVLTSS
PTPDDVAKITRRMYEKSEHRRKLGMMTRKIVQKSFSGDRYLREHEQMLWIGKSAKIMANRPHVNLQEPTDVATALQQTLP
IDEEVITIPRSAVNSWRSSAASGMSTLYSSVSNFPMLPTGNQRPSSIRSSLSNTSTDASSFMRLPSSASLPVFAPRQTLS
FSGGPGGDTHLSPGRLSPVVSRSGRHSRSQSISTAGREQLRGLQREDLHQYRNSDVSMIMREEFLQSSIFRGIEGGSGGS
NIV
```

Fig. 65
BASE SEQUENCE OF NUCLEIC ACID MOLECULE OF Aspergillus niger gtb3

```
ATGGTGGAAATCCTCGACGTCTCACCCGTCGGGTGGGTGTTCATGAAAGAATTCTGGTGGCAATATGTACGTGACTGTGT
GTCCTGCCTCGGAGAAACTTGTCTGGTGTTAACCTGTTCTACTTTGTTTTAGGTTCTGATTGCCATCTTGCTGGCAAGTG
TGGTCTGTGGATGTTCATATCTTACCTACTCTGGCACCCGCAGAGCTATACGATGGTATAAGGTGGGTTCCCACCCCCA
ACATGTATATGCTAATTGGAACCCCTTTATCTGATCTTCCCTTTGAGACAAGACCGCGTGTAGAAATTGTGCCGGCTGCT
GTCTCTCAACGCCTGGAAAAGATCGCCAACCAACAGCTTACCCTAGCCGCGGCGCATCACACGAAACGGAAGCCTACATC
CGTGGGAGTCTACCTAGGCACTTTTGCTACTCCTTTGGATGAGACGCATCGTCAGCTTCTCGATCGCTACGACCTCTTGA
TTGTGGATCCTTCCAAGTCCGGGGTTGTTCATGCAATTTTGCATACCGACGGGAAGCAGGTTTTGGGCCGAGTTGATCTC
GCTCTAAGTTCTTCCCAGCAGGACTTGACTCTCGCCGGCATCGAACAGATCGACAGCGCCCTGGCTGGAAGCTTTCACGG
AAGTGCCTTTTCTGGTATTGTGCTGGCGAATTGGGAGGACAAGTTCAAGCCCAAGGTTCTCGCCAAATTGGCCGAAGCCA
TCCACGGTCTGGGTCTGGCTGTGTATCTGGAGACTGGTCCGCCCACTTTCCTGGAGGATGGTCAATCGCTACAAACCCCG
GCCATCTCTGGTTTAGTCGTCCGAAATGCTAGTATCCTCCCCGACGGTCAGAAGCGAGACTACTTCCAGCTCGACAAGCT
GCGCCCAACCATCAAAGCCTTTGTGTCAGAGGCATGCATGAGAGACTTTTTGGTTCTGGCCTGGGAAACTGTCGACGACG
ATGTTACGCTTTCGAATGCTGTCGTTCAACGGTCTATGCAGTGGTGTAATTTCTACAGCGCAATTCCCTGGATTGGCCGC
AAGGCCGCTCTCGAGAACGCTGCCATCAATGTCAAGACCCCGGAGCCGCTGTCCTCCTTTAGTTGGCTGAAAGATGCGGA
GACCATGAAGGCCCACGATCGCTGGCGGCACCAACCTCGACATGGCACGCAATTTATGTTGCCAAGGCCTCTTGGGATACAC
TGCGCGCATATTTCCCCTCTGTGGACGACTTGCTCTTTTCTTCCGAACACTCGCCGACAATCAAAAACCCACCAGCCAAC
AAGCTTCGGCGAGCCTCCGGAATGGGTTGCTCAAGTCAAGTCACAGGGCAGTCGGCTGTCCATCTCCATGGCGGGTGTCGA
ATACAAGGAACTTGGTTGTTTCCCGCTCGGCTCAGAGGCAACACCCGTTGCTTTTGCAGAAATTGTTCATTCCCAGCAGC
GTCTGAAGTCACTCAACCTGCTTCATCCGGTTCCGTCGTCGAAATTGCAGAACATGGGGCTCCTCTTCCGACAGTTTTAT
GAAAATTTCGCCCTCTCGAGCTGGATGGCCTCGGACCAACTGGCTGCCTCTATCAAGGAGTTATCGAACATGGCAGCTAA
CGATACGCTGCGGGTACACCTCGGGCTGGATTCTGGTCTGCGCAAGAGTGCTGATGTCCGCTTCTGGGCCGTGTATCAGA
TGGACGCGGATGGCTTCGATGTCTTCGCCTCTAAGAATGCCCAGGGACTGGCTGGCACCGTATTGCACACCTTCCTCTCC
GCCAAAGGCTACCCCCGTCACGTTTGTTTCGAAGGCAGAAATTGCGTTGGCGAGATGGTCAAAAGATATCAACGAGGATAT
CGGGTTACCGCGTCGCATCATCCAGGACATTGACGCCTTAAGTCGGGAGGAACGACTTTTGCTGTTGCAGCATCTGTCAT
TGACCGATGCCAAGGGCGACCTTTCTGAAACCATGTGTGCGTACATCCGGCGACAACTTGTGGACGCGCCAACTCTGGCT
CAGCTGAAGGAGCTCAACACGGTCGCCTACCTGGAGGGGTCGGCTTCGCCAGAGCTCTTGATCGAGACTCGGATCAACTG
GTACAAGGAGCAGGGCTGCCAATATCCTTCTGCTGCCTCGTCTCTTGCATTGTTCTACGAGGCGGAGTCGGTCTTCACCA
AGGTACTGCGAGAGCGGAGAGAGGACGACCTCGCTCAGATCTCGAGTGGTCTGGGCCAGCTCGTCCAGGATGGTCCTATT
GATGCCTATACTGACGTACTGGTCCTGTCGTTGTTCTGCGCCGCACGAAAGGGTGCCCTCGACGAGATCTATGCCGAGGT
AACTGACCGGCAATCCGTTGTTCAACAACCAGTCCGACCAGGCCGCAGCTTTCGCCGAATCGTTTTGCTCTCGGATCCCGCT
GCGAAGCCTACTTCGATGTTTCGCCAAGTGCCTTTGGAAAGCTTCTGTCGGATCGTTTCCGCAAAAGCTACAACGATGAG
AAGCTTCCTGACTGGATCCACGGTGCTCCGGACATGGCTACTTCATATGCCGGTGCCCAGATTGATGTCGATGCCACTCA
CAAGGTCAAGCCCATGCGTGGATATCGAGCGCTTCACTTTCCTCAGTGTGTTCGCTTTTCCTGCTCTGATTGATATCATTC
TTCTCACGATCATCGGTCGCGGACTGTATCTCTCTGCCTTCATGACGGCCGAAGAGCAACAGAGTGCGACTATTGCACTC
ATGATTTCGCTCTTGCTCTCCGGTGCTATTGGCACCTGGATTGCTTGCGGAGGACCCTATTACCTCATCTCCATGGCTTT
CGCAGCTGCCAACATGTTTGTTCTGATCAGACTGATTGCTGGCATCGCCTTCACAGTAGCTGGTGGTCTCATCGGTTTCA
TCTGCATTTCGGGCCGCCGTGAGCCCGCGGGCCGGAATCATCTTGTACCTCTACCTCATTGCCCTGACACTCTATTTCTCG
TGTTTCGCCTCGCTGGCGAGTTTCAGCTACCCTGGCTCCACGTTCCTCTCCGGCCGCAAGGTCATCTTCGCATGTGTCCC
GATCTTATTTGTCTCCCCCATTGTTACCACTTTCACCGGTCATGACTCGGCCATCTACCTTGCTGTGATCTATGCTTTTA
TCGGATTGCTGCTGCTTGGTCTGAGATCGGTCTCCTCCAAATGGGTCACTTGGTACCAGAGCATTCGGAGAACAGATGAT
ACCGAAATCCGAAAGTGGTACGTTGCCACTTACGGTAACAACGATGAGAAGGTCTTTGGAAATTTGAGTGACCCGGCCGT
CCTAAAGCTATCCCGAGAGGCGTTGTTCAAGGATGTTCTCGCGGAGACTAAACGCTGGTTCTACCAGAAGCCTACCACCG
ACAAGTTGGTGCTGGAGCTAGCCAAGGATTGGGAGGCGACCAACTTCCTCCTCGACTGGTACTGCAGATATGCCGACGTA
CCCAGGCCAATTCCTTTCAGTTCTTCCTGGAACATCCAGACCAAAGTTGGACTGGAGGTGCTCCGGAACTCGCAAAAGGG
CATCAGGCTGCACAATGCCTTCATCCAGTGGCGACAGTCCAGCAGAGAAATCGGATGCGGTGTCCTGTACTTCTTGCTAG
CCCTGCTTGACAAGTGGGTGGAGCTACTCACCGGCGGCCAAATGACAGGTCTTGCCCCTTGGGTTACCAGTTCGCAGCGG
ATGGCCGTCGGATTTGGCCTGGCATACTACCTAATCGGTGCGGTCCTCATCGACACCAAGGCTCAGGAGCTTCATGATCT
TGTTGGAAAGCAGACAACGCTTGCCGTGCCCAATGCTAAAGATATCCGCTTGGCGCAGAAGCGGGACGTGAAATACAAGA
```

Fig. 66
GAATGGTATACTGGAGAACTCTATTCAAGTATCTCGGGTGGCACGTATGGAGTTTGGGCCTTGCCACCGGCTCTGATCTGG
ACCTTCCAGGATACAATGGAAGCGATGATCATCTTTGTCGCTTACATTCTGGCATACACCGGTCTCCTTTGGTACCAGTA
CACGAAGATCTTCTCCGGCCCGCATGCATTCAAGACCCTACTCATTGGGTGTGTCGTTGGCTTACCGGTTGGCATCGCTC
TCAAGACCCGCCTGCCGCACTTCTTGTATTCGGAAGTCATTGGTCTCGGGTCTGCCACATGGACTGTCGCTATCCTCACA
CTATTCAAGGCGAAGATGGGCATGCCGAAGAAGGTCTCATCTCCGGTGGAGCTTGGAAGGGTATTCCACGCATACTGGTC
TCCCTGGTCAGATCCGGAATGGTCCCAACAGGAGCTGCAAACGTTCTACGAGAAGCTCTCGCTTGTTCCGTCCGACGCGC
GCTTGAGCCTGAGTCCCCAAGCCCATCCCGGTGTGGAAGTCAAAGAGATCCTACTTTCGCGCAGAAAGGAAACAAGAATT
GAAGAAGCATTCCCCAAGTCCGACGACCTCGTGAACCTGGCGTTAGGCGCCTGGGGCAAAGGCGAAATCTCCCTGGAGCT
TGTTCCCGTTGGCTCACTGGGTCCTGGCATTCATGCATTGAGTTGTTGTACGTCAGGCCAACTGCACATCGCCATCTGTG
TAGGCCGCGGACTAGACCAACGGATTGACGTCAGTGCGAACTGCCAGGTCATCGCAGAGACTCTGCTTCACGCTGTTGCA
GAATCGATGCTGCATATGCCTCATGAACATGCTGTACTTGCCGAGTCGCTCGTCACGGCAGGTGTGACGGAAACCATGGC
ACGTCAACTTCGCGCGGAGCCTAATACACCGGTCGTCATACGCTGGGCCAAGAAGGAGCTCCTTCAGCAGCTGTGCCTCG
GATTCGACTGTGATTCTCACTGGGAAAAGCTGCCCAAGGACGTCAGACAGGCTTTGATCAACCGGTGCCTTGGCCAGCCA
TGCCAGCTCTCTGAGGCTAGCCGGCAATGGCTGGAAGGAAGGCTTTGCCAGTTCGATGCTGATACCCTCGATGTGCACGT
CGCCCGAAGCAATCTCGGAGCTGCTAGTGCTGTCAGCATTCTGGATTACGCACACTACGGGTACTGGTGAAGCAGCCACTT
TCAACGATCCTGAGACTCCAGAGCATATTCCATATGTCCCGAAGAAGCTTCCTTCGATCATTCAAATGCTGGCAAAGCCC
TGGAACACCATCTACTACGCTTTCGCTTCAGTTGTCAAGTTCATTGTGGTTGCTCTCGTCGCCGATCCCGAATTCCAGCG
AGAATTCGATCATGTTATCGGGCAACACCATGCCATTATCCGCGTACCGGCTACCCTGGCATTGAGCTTGCTCTGGTCTT
ATTCAAGAATTATGCAGAATATGGGTCTCTCCTTCTTTTTGTTGCATGGTCGTGATAATGTGAAGCAGCTCTGGAATGAG
GCCAAGGGAATGACCATCAGCATCCAAAAGAGCAGGTTCATCATTCAAAGTCTGGATGGCACATTCACTGCCTTCAAGCA
TGATGAAACGGATGGAGGCTTCAAAATCTATTACTACTCCGGCCAGCACAAGACAGAGCCTGAAGGCACAAAGAGTCTCA
GCTACGTCTGTGTTTACTCCAAGGATGTGCTGCTTATGGTCCGCCAGGAGTTCAAGGGTGGAAAGCTGCTCAACGAGTAC
CATTACGACTACCGCGCCCCGACCAAGAAGGCCTTTGGCTTATCCAAGTCGTCCCAAGCAAGAATCCCAATGGGCCGGCG
TTGTGTCCGCGGAGACAACCATTTGCAGAGTGTGCAGTACAACCGGAAGGGACTCATCGAGGCAGGATCTTACANNNNNN
NNNNNNNNNNNNNNNNNNNNNNNNNNNNNNNNNNNNNNNNNNNNNNNNNNNNNNNNNNNNNNNNNNNNNNNNNNNNNNNN
NNNNNNNNNNNNNTTATCGCAAGAACCCCCGTTTTGGTGACGAGTTGCTTCGAGCCGAGTTTGCTCTCACACATCAC
TTGTACGGTCTCATGGTGCGCTCCTCCTCTGCGCCATCCCGAGAAGATAGACCGTTGGATCCCTCACTCCAAGGTCACCG
AGGCAACTTTCGTTCAGGGCGCCGATGTCTACGAGGCACGTTGGCTCTACGATCACAAGTTCCATCCCACTATCTTCACC
ACGCTCAACGGACAAAAGGTGCAGACGCCCCCCATGATGGAACACGACTACCTGGGAGTGCTGGCCAAGCCGAAACACAC
CAGCTTTGTGCATGACAATCCTCTCCTGTACTGTGATAGTTTGAACTCAAGCATCTTCAGCCGGTTCTTCGGACTCACCA
AGAAGCGCTTCCCCGTGTCAACGTCTCGCGCTCGCTCGTTGATCTGGAAGGCCTGGAAGGAACGTGTCGACTTTGATGGT
GTCATCGTTCGCTGGATGGATGAACGACTCTTGCGCCGAGATAAGACCCTCGCTCCCTACTGGCGTAGTCGGGATCGCGG
TGACCTTGCTTCGGCCAAGAAGTATCTGGATGTCCGCGCAGACACCATCACAGCCAGTGCAGATCTGGACGACAACATCT
CTAGCTGGACCCCGCTTGCCGTGAAGATCAGTGATCTTTTCAACTTTGGCCCTGGTGGTGATGCAGTCGTCAACACTAGA
TCCAAGGACTTTGGCGCTGATACGGAGAAGAGCCTGCATGTCATGGCTGCTGACAATGGTACCTGGCCAAACGAAGGAGG
TGGCCGTTTCTGCATGCCGACGCGATATGATCAACTCCCTGAGGACTATCAAGTGGCATATGATTTGCGAGTCTGCCAATG
ACTTTGGCATTCCCAAGCACCAGACCGAGCAGAACATTCTTTCGTTGAAGGTTGTCCCTCTCTGGGGTCTCGACTTGCCTC
ACGCCCACGCACGGTCTCTTCAGGAACAAGCTGGACTCGGAAGTAGAGAATGTCACTTCCGCCAGTGAGATGGACATCAA
GATGAACTTCATCCCCATCTTGACGGCACTAGTCAAGGGAGCTGCGCTATCCATCTGTCCAAGGCGGATATCCAGCAAG
CGACTCGAGCCTTGGTCAATCTCAACACCTACTTCCAAGATTCCCGGCACTGGACCCAAGTCTGGGACAGTGAGATTGTC
AAGGAAAGCTGGCGCGACCTGTGGCTCAGTCAAGAAATGCCCAACACCGTCCCTTCGTCTGAATGGTTCCGCACGGAACT
CCCCACGCTGGCCTCTCTCGACATTGCACTGGAACTCTGGTATCGCTACCTGTTCATCTTCTCGATTCCAATCCCGAGA
AGATCCCCAATGTCTTCCAAGCATCGCACCACAGTGTCAGTGCATCTTACGGTGTCGTCTGCAAGGTGAAGAGAAACTGC
ACACTCCAGATCTGGGACCATGCCATCAGTTGGCGTGAGACCAACCTCTGCCTGTCATCCGCACTTTGCAAGCTCTCTCC
CTTCGTCCGCAACTCCCTACTCGGCCTCATGCGCGTCACCTCGGTCCTAACCCTGCACCACGGCCGATATCATCTCCCCCT
GCGCCGACTTCTTCAACCCAGGCTGGGAAGTCGAGATCGGCACCTGCCAGGGCACCATCGACACCGCAACGTCTTCCGC
CGCAAGGTCGACCCCGTCGTCAACGGGCATCACAGACATGCAGAAGTTTGCCCCCGTCAAAGAGATCAAATCCCAGCGCCC
AACCGTCACCATGTTATCCCACGTCTGGTACGCCAAAGACATCGAAATCGCCCTCCTGGCCGCGGAACATCATCATCAACCC
AGTGGAAGTTCGACGACTACCACCTTGACATCTACGGAGCCATCGACAAAAGCCCCTACCTACTCCACGGAATGTCAAGAA
ATCATCGCCTCCAAGGGCCTCCGCGGGCAAAGTCACCCTCCGCGGGCACCGCCGACCCCATGAAAGTCCTCGAGAACACCTG

Fig. 67
GCTCTTCCTCAACTCTTCCCTCTCCGAAGGTCTCCCCCTCGCCCTCGGCGAAGCCGCCCTAACCGGCGCCCCCGTCGTCT
GCACCGACGTCGGGCGCCTCCCTCCGCGTCCTCAGCGACCCAGATGACTTCTCCCGGCTTCAGCGCCGTCGTCGCCCCCAAC
GACGCCCTCGCCCTCGCAAAGGCCCAAATCACCATGCTCGGCCTCCTCGGCGAATGGAGCAAGTACGCCGAAGACGACGC
TCCACCACCAGTGCTTACCTCCTCCCCGACCCCGACGACGTCGCCAAGATCACCCGTCGCATGTACGAGAAGAGCGAGC
ACCGTCGCAAACTGGGAATGATGACCCGCAAGATCGTCCAGAAATCCTTCAGCGGTGATCGCTACCTCCGTGAACATGAG
CAAATGCTCTGGATCGGCAAATCCGCTAAGATCATGGCCAACCGTCCGCACGTCAACCTCCAAGAGCCCACGGACGTCGC
CACGGCGCTGCAGCAGACCCTCCCCATCGACGAAGAAGTCATCACTATCCCCCGCAGCGCGGTCAACTCCTGGCGCTCGT
CCGCTGCATCAGGCATGTCCACTCTCTACAGCTCCGTCTCGAACTTTCCGATGCTGCCCACCGGCAATCAACGTCCTTCG
TCTATCCGGTCCAGTCTAAGTAATACCTCCACGGACGCGAGCTCCTTCATGCGCCTCCCCAGCAGCGCTTCCCTCCCTGT
CTTTGCACCCCGGCAGACACTGTCTTTCTCCGGTGGACCAGGCGGAGATACTCATCTTTCCCCTGGTCGTTTGTCGCCGG
TGGTGAGCCGCTCCGGACGTCATTCGCGCTCTCAGTCTATTTCTACCGCTGGAAGAGAGCAGCTGCGTGGTCTGCAACGT
GAGGATCTGCATCAGTATCGCAACTCAGATGTCAGCATGATTATGAGAGAGGAGTTTCTGCAATCGAGCATTTTCAGGGG
CATTGAAGGTGGCAGTGGTGGTAGCAACATCGTCTGA

Fig. 68
PUTATIVE AMINO ACID SEQUENCE OF Aspergillus fumigatus Uge3

MDSYQQSDASTPVEPCSPGCVDTPATQSSVLFDGHLDDLLRHFPLDQYILVTGGLGFIGSHTTLELLKANYNVIVIDNLS
NSFQIVFDRIKLLASQYHERQGTKMPSLHLHAHDYRDTAALKELLEQHQTQTRWGTTKSKISGVIHFAAYKAVEESIRNP
LKYYANNVSGLIDFATTLGDYGIKTFIFSSSATVYGTLATSGLPLKEELCTHKEEIYTDHDGSERIVQPGCTGITNPYGR
TKWICEAILADLAASDPEWTIVALRYFNPIGCDESGLLGEDPRQTPTNLLPVVVKVMTGEYRELQMFGTDWNTEDGTAVR
DFIHVTDLARGHIAALSAANEGKLAENFRTFNLGTGRGHSVKEVVETMEEVSSKHIPRRAADRRAGDVGSCVAVATRSQQ
ELNWKTEKSLKDACVSLCNFLEVSGLST

BASE SEQUENCE OF NUCLEIC ACID MOLECULE OF Aspergillus fumigatus uge3 (Genbank accession No. AFUA_3G07910)

ATGGACAGCTACCAGCAATCCGACGCAAGCACTCCGGTGGAGCCTTGCTCCCCAGGCTGCGTGGACACGCCCGCAACGCA
ATCGTCCGTCTTGTTTGATGGTCATCTGGACGATCTCCTGCGCCACTTCCCTCTCGACCAGTACATCCTTGTCACGGGCG
GCCTCGGCTTCATTGGCAGTCACACAACATTGGAACTGCTCAAGGCCAATTATAATGTGATTGTGATCGACAATCTCAGC
AACTCCTTTCAGATCGTCTTCGACCGCATCAAGCTGTTAGCCTCCCAGTACCATGAGCGGCAGGGGACCAAGATGCCGTC
GCTGCACCTGCATGCACACGACTATCGTGACACTGCTGCTCTCAAGGAACTTCTAGAACAGCACCAGACCCAGACCCGAT
GGGGTACGACCAAGTCCAAGATCTCTGGTGTCATTCACTTCGCTGCCTACAAGGCAGTGGAGGAGAGCATCCGCAACCCA
CTCAAGTACTATGCCAACAACGTCAGCGGCCTCATCGACTTTGCCACGACCCTGGGTGACTATGGCATCAAGACTTTTAT
CTTCTCCTCGTCGGCCACAGTGTACGGCACCTTGGCAACCTCCGGTCTCCCCCTGAAGGAAGAGCTGTGCACGCACAAGG
AGGAGATCTATACCGACCACGACGGGAGTGAACGCATTGTCCAGCCCGGCTGTACAGGCATCACCAACCCCTATGGCCGT
ACCAAATGGATCTGCGAGGCCATCCTGGCGGACCTCGCCGCCTCCGACCCAGAATGGACTATCGTCGCTCTGCGGTACTT
CAACCCCATCGGATGTGACGAGTCCGGCCTCCTCGGAGAAGACCCCAGACAGACTCCCACAAACTTACTTCCTGTCGTCG
TCAAAGTCATGACAGGCGAGTACCGGGAGTTGCAGATGTTCGGAACTGACTGGAATACTGAGGACGGGACGGCCGTCCGG
GACTTCATCCACGTCACCGACCTTGCGCGCGGCCACATCGCGGCTCTCAGCGCAGCCAACGAAGGCAAACTGGCCGAGAA
CTTCCGCACGTTCAACCTGGGAACCGGTCGCGGACACTCCGTCAAGGAAGTAGTCGAGACCATGGAGGAAGTTTCCTCCA
AGCACATCCCCCGAAGGGCGGCTGATCGCCGCGCGGGGGATGTGGGCTCCTGCGTCGCCGTGGCCACGCGATCGCAGCAG
GAGCTCAACTGGAAGACGGAAAAGTCACTCAAGGATGCTTGTGTGAGCTTGTGCAATTTCCTGGAAGTCAGTGGGTTATC
TACTTAG

Fig. 69
PUTATIVE AMINO ACID SEQUENCE OF Aspergillus fumigatus Sph3

MAEKHVSNRRCLQSRRSRILLAVFVLIAILAVVIPPAVVVTLHKKNDMGPKSKVFVPLYVYPAPGAWTPLEDVISKHPDV
NFTVVINPGSGPGPNALPDGNYTREIPKLASYENVRLLGYVATTYAKRNISLVRRDIETYAAWPTNSSNPALAVRGIFFD
ETPQQYDEDALAYLQELTDVVKNTPGLGPDHYVVHNPGAIPDSRYLSTADSTVVFEATYDTFQERHGAKLFEAIPDSNRS
QLCAVIHSVPESVEGSALRSLVKQVRKVADEIFITHLDTDYYASFGRQWPEFVDLMGK

BASE SEQUENCE OF NUCLEIC ACID MOLECULE OF Aspergillus fumigatus sph3 (Genbank accession No.
AFUA_3G07900)

ATGGCGGAAAAACACGTGAGCAATCGACGGTGCCTGCAAAGCCGGCGCTCTCGAATCCTCTTGGCCGTCTTTGTTCTTAT
TGCTATTCTGGCTGTCGTGATCCCTCCGGCGGTTGTGGTGACGCTGCACAAGAAGAACGACATGGGGCCTAAATCCAAGG
TCTTTGTGCCTCTCTATGTGTACCCTGCACCCGGAGCCTGGACTCCGCTTGAAGATGTGTATGTTTTCCGCCCACGTTCA
CCTTGACCTTGGTCATCTTGGGCTAGCTGAATCATTTAGTCAGCATTGAGGACAACAGCTGACGCCACACCCACATATAC
ACACACACAGGATCTCCAAACACCCAGACGTGAACTTTACCGTTGTGATCAACCCAGGGAGCGGACCTGGACCCAACGCA
CTGCCGGATGGCAACTACACGCGTGAGATTCCCAAGCTGGCTTCGTACGAGAATGTGCGGCTGCTAGGCTATGTGGCGAC
AACCTACGCGAAGCGCAATATCTCGCTGGTGCGCCGGGACATCGAGACGTATGCAGCGTGGCCAACGAACTCTTCCAACC
CGGCTCTAGCTGTTCGGGGGATCTTTTTCGACGAGACCCCTCAGCAGTATGATGAGGATGCCTTGGCGTATCTGCAGGAG
TTGACCGACGTTGTGAAAAATACCCCTGGTTTGGGGCCGGATCATTACGTACGTTTCCCTGGTAATTCATTATCATATTT
GGTAATTTTTATTTCCATTTTTATTTATTTTTTTATTTGTTTGGTTTTGTTTCCTCGCTTGCCACCTTCCCAGTGTATA
TATCACTTTGTTTTTTTTTTTTTTTTCAGTCAAGCTGTCGTCTACAGTTTGCAAGTGCTAAAATGCTCACTAATTACAG
GTGGTTCACAATCCCGGCGCGATCCCTGACTCTCGCTACCTGTCGACTGCAGACTCGACTGTCGTGTTCGAAGCAACGTA
CGACACCTTTCAGGAACGCCATGGAGCCAAGCTGTTCGAGGCGATCCCGGACAGCAACCGCAGCCAGCTCTGTGCGGTGA
TCCACTCCGTCCCCGAGAGTGTCGAAGGGTCTGCGCTCCGGAGTTTGGTGAAGCAGGTCCGCAAGGTTGCCGATGAGATC
TTCATCACCCACTTGGATACGGATTACTATGCCAGTTTTGGGCGGCAGTGGCCGGAGTTTGTGGATTTGATGGGAAAATA
G

Fig. 70
PUTATIVE AMINO ACID SEQUENCE OF Aspergillus fumigatus Ega3 (Genbank accession No. AFUA_3G07890)

MDSLGKGQSAGGWKSWTTRKKLFVLALVLLVIIALGVGLGVGLGIGLGGGGGGEGEEGSGGETTPPEGNYTTAKWQPAVG
TKWQIELLYALNDTSVDAEIYDIDLFINDKSTIAGLQRAGRKVICYFSAGSYENWRPDKDKFKDSDLGHDLDDWPGEKWL
NISSANVRQIMLDRLDMARDKGCDGVDPDNVDGYDNDNGLDLTQADSISFVNFLANAAHARNMSIGLKNAGDIIPSVIKN
MQWSVNEQCAQYNECDTYAVFPQNGKPVFHIEYPKGDKTNNDLSVTASQKNAACDFAGSANFSTVIKNMNLNNWVEYC

BASE SEQUENCE OF NUCLEIC ACID MOLECULE OF Aspergillus fumigatus ega3 (Genbank accession No. AFUA_3G07890)

ATGGATTCCCTTGGAAAAGGCCAGTCGGCCGGCGGCTGGAAATCATGGACCACCAGGAAGAAGCTCTTCGTCCTCGCGCT
CGTTCTCCTCGTCATCATCGCCCTGGGAGTCGGTCTCGGAGTTGGACTCGGCATCGGTCTGGGCGGCGGCGGCGGCGGCG
AAGGTGAAGAAGGCTCAGGCGGGGAGACCACACCGCCAGAAGGCAACTACACCACGGCCAAGTGGCAGCCAGCGGTGGGA
ACCAAATGGCAGATCGAGCTGCTTTACGCGTTGAACGACACCTCCGTCGACGCTGAGATCTACGACATCGACCTGTTCAT
CAACGACAAGTCCACCATCGCAGGACTCCAACGAGCCGGCCGCAAGGTGATCTGCTACTTCTCGGCAGGCAGCTACGAGA
ACTGGCGACCGGACAAGGACAAGTTCAAGGACTCGGATCTGGGCCACGACCTGGACGACTGGCCGGGAGAGAAATGGCTG
AACATCAGCTCGGCAAACGTACGCCAGATCATGCTGGACCGGTTGGACATGGCGCGCGACAAGGGCTGCGACGGGGTGGA
CCCGGACAACGTCGACGGGTACGACAATGACAACGGGCTGGACCTGACGCAGGCGGACTCGATCAGCTTTGTGAACTTCC
TGGCGAATGCGGCGCATGCGCGGAACATGTCGATTGGCCTGAAGAACGCGGGGGACATCATCCCGTCGGTGATCAAAAAC
ATGCAGTGGAGTGTCAACGAGCAGTGTGCGCAGTACAACGAGTGCGACACCTACGCGGTGTTTCCGCAGAATGGCAAGCC
GGTGTTTCACATCGAGTATCCCAAGGGGGATAAGACCAACAATGATCTGTCCGTCACGGCCAGTCAGAAGAACGCGGCGT
GCGACTTTGCCGGCTCGGCGAATTTCTCCACTGTCATTAAGAATATGAATCTGAACAATTGGGTGGAATATTGTTAG

Fig. 71
PUTATIVE AMINO ACID SEQUENCE OF Aspergillus fumigatus Agd3 (Genbank accession No. AFUA_3G07870)

MVFAWVIQAGCFFGFIKWVWTPHPTVVTSVPPSQASVSSSSVTSTVGLTTSSAVLSLTATPVTPTGTTLVSSVSSSSSSS
SSSSSSSSSSSSSSSSSSSSSSAAAAASSSIGLSSTMSLSLSSSAIPSVTPSATPVSHGSVLSNILVIAKDSSAASSATSG
LNAYGIPYTTLLVPQAGVGLPALNSSNVGNYGGIVVAAEVSYDYGGTTGYQSALTTDQWNQLYAYQLEYGVRMVQFDVYP
GPKFGASAVNGGCCNTGVEQLLSFTDTSDFPTAGLKTGATVSTEGLWHYPATISNSSNTKEIAQFAPNAVTSTASTAAVI
NNFDGREQMAFFIGFATDWSATSNYLQHAWITWLTRGLYAGHRRVNLNTQIDDMFLVTDIYYPNGSTFRITVEDMNGISA
WVPTINAKMNPGSSYFVEVGHNGNGNIEQSSSTDAGAAACNGGGIEYDSPPDTPLEFKKPLGTGTDLWPSTPTTYDWTVA
CTQLDDLLRWWTTPANRDAFGHISHTFTHEEQNNATYADVFKEISFNQAWLKQVGLDQAKWFTSNGIIPPAITGLHNGDA
LQAWWDNGIRNCVGDNTRPVLMNQQNAMWPYFTTVESDGFAGMQVNPRWATRIYYNCDTPACTVQEWIDTSAGAGSFDDL
LAVEKADTMRHLLGLRHDGYMFHQANLRNADVTPITVNGVTAKYSIFQAWVETIVQEFVRLVDWPLVTITHQEMSENFLA
RYQRDQCGYGLSYAVADKKITAVTVTATGNTCSRPIPVTFPVAPTSTQGYATEQLGSDPLTVWVQLSGSPVTFTLSTPIA
L

BASE SEQUENCE OF NUCLEIC ACID MOLECULE OF Aspergillus fumigatus agd3(Genbank accession No. AFUA_3G07870)

ATGGTCTTCGCGTGGGTGATTCAGGCCGGTTGCTTCTTTGGCTTTATAAAATGTACGACTCCCCCAGGGGTCTGGACTCC
ACATCCCACCGTCGTTACATCTGTGCCTCCATCCCAGGCCAGTGTATCGAGCAGTAGTGTAACATCTACTGTTGGGCTGA
CGACCTCGTCTGCTGTACTCTCGTTAACCGCCACCCCGGTGACTGCCACCGGAACCACTCTCGTTTCGTCTGTTTCTTCT
TCTTCTTCTTCTTCTTCTTCTTCTTCTTCTTCTTCTTCTTCTTCTTCTTCTTCTTCTTCTTCTTCTTCTTCTTCTTCTGC
TGCTGCTGCTGCGTCTTCCTCGATTGGCCTGTCCTCCACCATGTCTCTCAGCCTCAGTTCGAGCGGCCATCCCCTCGGTGA
CCCCCTCGGCGACTCCCGTCAGCCACGGCTCGGTCTTGTCCAACATCCTGGTGATCGCCAAGGACTCGTCGGCGGCCAGT
TCGGCGACCTCGGGGCTCAATGCGTACGGCATCCCGTACACCACCTTGCTGGTCCCCCAGGCGGGTGTGGGCCTCCCGGC
TGTCAACTCCAGCAATGTCGGCAACTACGGCGGGATTGTCGTGGCGGCCGAGGTCAGCTACGACTACGGGGGCACGACCG
GCTACCAGAGCGCCTTGACCACCGACCAGTGGAACCAGCTGTATGCCTACCAGCTCGAGTACGGCGTGCGCATGGTGCAG
TTCGACGTCTACCCCGGCCCCAAGTTTGGCGCCAGTGCGGTCAACGGCGGTTGCTGCAACACCGGCGTGGAGCAGCTGCT
CTCGTTCACCGACACCAGTGACTTCCCCACGGCCGGCTTGAAGACGGGCGCGACGGTCAGCACCGAGGGCCTCTGGCACT
ACCCGGCCACGATCAGCAACTCGAGCAACACCAAGGAGATCGCCCAGTTCGCTCCCAACGCGGTCACCTCGACCGCGAGC
ACTGCCGGCGGTCATCAACAACTTTGACGGCCGCGAGCAGATGGCGTTCTTCATTGGCTTTGCCACCGACTGGAGCGCGAC
CTCCAACTACCTGCAGCACGCCTGGATCACCTGGCTCACCCGCGGGCTGTACGCGGGCCACCGCGCGTCAACCTGAACA
CGCAGATCGACGACATGTTCCTCGTCACCGACATCTACTACCCGAACGGATCCACCTTCCGCATCACCGTCGAGGACATG
AACGGCATCTCGGCCTGGGTCCCGACCATCAACGCCAAGATGAACCCCGGCAGCTCGTACTTTGTCGAGGTGGGCCACAA
CGGCAACGGCAACATCGAGCAGTCGTCTTCCACCGACGCGGGGGCGCCCTGCAACGGGGGCGGCATCGAATACGACT
CGCCCCCGGACACTCCCCTGGAATTCAAGAAGCCCCTGGGCACGGGGACCGACCTCTGGCCCTCGACGCCGACGACCTAC
GACTGGACGGTCGCCTGCACCCAGCTCGATGACTTGCTGCGGTGGTGGACCACGCCGGCCAACCGCGACGCGTTCGGCCA
CATCTCGCACACCTTCACCCACGAGGAGCAGAACAACGCGACCTACGCGGACGTCTTCAAGGAGATTTCCTTCAACCAGG
CCTGGTTGAAGCAGGTCGGCTTGGACCAGGCCAAGTGGTTCACCTCCAATGGCATCATCCCCCCGGCCATCACCGGTCTG
CACAACGGCGATGCGCTGCAGGCCTGGTGGGACAATGGCATCCGCAACTGCGTGGGCGACAACACCCGCCCGGTGCTGAT
GAACCAGCAGAACGCCATGTGGCCGTATTTCACCACGGTGGAGTCGGACGGGTTCGCCGGCATGCAGGTGAACCCCCGCT
GGGCCACGGGCATCTACTACAACTGCGACACGCCGGCCTGCACCGTGCAGGAGTGGATCGACACCTCCGCCGGCGCCGGC
AGCTTCGACGACCTGCTGGCCGTGGAGAAGGCCGACACCATGCGCCATCTCCTCGGCCTGCGGCATGACGGGTACATGTT
CCACCAGGCCAACCTGCGCAACGCGGACGTGACCCCGATCACGGTCAACGGCGTGACGGCCAAGTACTCGATTTTCCAGG
CGTGGGTTGAGACGATTGTGCAGGAATTCGTCCGCCTGGTCGACTGGCCGTTGGTCACCATCACCCACCAAGAGGTATGT
CCCTATCCTTTTTCTTACGATGTCTACCTGTACAAACTACAGCCTGGCTAACAACTCTGGTAGATGTCCGAGAACTTCCT
TGCGCGGTACCAGCGCGACCAGTGTGGCTACGGCCTGTCGTACGCCGTCGCCGACAAGAAAATCACCGCCGTGACGGTGA
CGGCCACGGGCAACACCTGCAGCCGTCCGATCCCAGTGACCTTCCCGGTGGCTCCCACCAGCACGCAGGGCTATGCCACC
GAGCAGCTGGGAAGTGATCCCTTGACGGTGTGGGTGCAGCTGTCGGGATCGCCTGTGACCTTTACGCTTTCCACTCCTAT
TGCTTTGTAG

Fig. 72
PUTATIVE AMINO ACID SEQUENCE OF Aspergillus fumigatus Gtb3 (Genbank accession No. AFUA_3G07860)

```
MDQPGDAARMHGPAVHPLCQARRKRKLLLSALNRALLRGLLSLTRLVRDGMAATLLTPSFWSSRIAGFSRLFLVRVHACQ
PDVFSAVVTPRRFHPLGQKHTLLLSAILAQTGQTDRQQRSYFCLHQRALPRQTVLIGLLLGSVVIGCSYLLYAGLSRARK
WYQVGIRSMSSVDALEEIADILQSRAQSAVVPRNVLDRLDRLSRQQLSLPNVQWAKKPSSFGVYLGSFDASPTRDQSRLL
SQWDLLIVDPAQSGVVEALSRAERKQFLGRVDVGSGSGSTLAAIDRIESALSRFDGAPFSGMLLANWESSFNPAAIRKLA
EALHAFGLPVYLETAPPDFLQDHKTLQTDAIAGLVIRNASIMPDGEKRDYFQMIKMQPTIKAFVSEACMRDFVVMAWETV
DDNAHLSNAVIQRSLQWCNFYSAITWIGRQAALHDASLNVKIPEPLSAFSWLKEAEIMKVHDIWRANLNLQEEEVGPRDA
WTALLQYFPTLSNVLTSSEREPPSHMDSATIAVRDPPEWVAQVRSQGSPLSISMAGVEYKEFGCFPLGSEATAVAFVEIL
KSQQRLKSLGLLHPVPSDKIQKLGALLRRFHDKFAVSHWPDLPTLPATIKDLANFASQDSLRINLGLDSGLRKSADVRFW
AVYQSDADGFEVFASKSAQGLAGTVLHTFLSARGFPRHVCFEAETALAQWSKDVNEDIGLPRRLIQDVDALSPEERLLLL
QHLSLTDAKSELSETICRYIRRQLIDAPSLAQLKELNTVAYLDGSLPPEALIKSRIHWYRDQGCRSPAPAACLALFQETD
AVFTRILRERRESDLAQITNALCQLVQKDRIDVYADILTLSLFCAARKGAFDEIYMEVTDRNPLFNDQSDQAAAFAESFA
LGSRCEAYFDLSPSAFGKLLSGRFRRYYQDRELPDWINGAPQMATSYAGAQIDVNPDDKVKPMRGYQRFTFLSVFAVPAL
IDILLLTLYGRGLYLSGHMPEEVMHSASIALMISLLLSGAAGTWIACGGSYYLISMAFAATNMFVFIRLIACFAFTIAVG
LVGFIVMSAVKGPGPGIVFYLYLIALTLYFSIFASLACFSYPGSKFLSGRKAIFACIPVLFISPIVTNWSHHDVVIYLIV
LYIFIGLLLLSLRSVASKWVTWYQNIRRTDDTEIRKWYVSKYGNNDEKCFGGRSDPAVLKLSREALYRDVMAEVSRGFFS
KPTTDQLVLELARDWEATNFLLDWYCRYADVPRPIPFSSGWNIQTKVGLDVLRNSQKGQRLHNAFMHWRQSSREIGCGVL
YFVLALLDKWADLLTGGRMTGFLQMPNGDTRFAVGFGLAYYLIGAVLIDTKAQELHDLIGGQTNQAVGTSKEIRPSQKRA
VRFKRKVYWRTFVKYLMWQVWSLALSTALLWTFRSSVDAMAMFCAYVLSYTGLLWYQYTKIFAGPHALRPLLAGIVVGLP
VGIVLKTCVSGNFSNYGPVIGLGTATWTTAILTLLTAKMGMPKKVDSPVDLGKTFHAYTTPWADPEWSQQELQTFFERIS
LVPSDTRLKLEPGAHPGMEVKSLLLSRREEPRIEEAFPKASELIHRALQAWAQGEISIELVPLGSLGPGIRALSCHAADQ
LKLVLAVGRGLDQRIDVSGNCQVIAETLLHAVSESMLRMPHEYAVLAESLVTAGVTETMARQLREEPNTPVVVRWAKKEL
LRELCLGFECDTHWEKLPKTIRKALLDRCVGKPSHFSERDRQWLQEHLCRFDTSDLDVHVARCNLGAATAVSILDYAHYG
TGEEALGKDSETPLFIPYVSKKLPAALAFVKDPLHNFWYSVASAIKFIIIALIADPEFQREFDHVMKQRARIIRVPCVFL
LNLIWSYSKIVQDVILSFFLFHGRDNVKRLWDETKGMTISIKKSRFMLQSLDGTFTAFKHDDEDGGFKVYYYSGEHKTEP
EGTKSLKYVSTYSKDMLLLIRQEFKDGKAINEFHYDYRAPNKKSLRLTRGSDTRIPLGRRCIRGDSHLQSVQYNRKGLIE
AGSYMKDGNLIRFKYHYRKNPRFGDELLRAEFVLSHITCTVSWCAPPVRHPEKVERWIPHSKVTEATFVQGADVYEARWL
YDHKFHPTIFTTLNGQKIQTPPMIEHDFLGVLAKPKYTSFVHDNPLFYCDSLSSNAITRFLGLSTKRFPVSTSRARSLVW
KAWKDRVDFDGIIVRWMDERLLRRDKTLAPYWRSRDRGDLASAKKYLDLRADTVMASADLDDNISSWTPMAIKVSDLLNF
GPGGDAVVNTRSKDFGSDTDKSLHVMAADTGTWPNEGGGVSACRRDMINSLRTIKWHMICESANDFGIPKHQTEQNVLSL
KMIPLWGLDFLTPTHGLFKNKLDSEVENVTSANDMDIKMNFIPILTALVKGARAIELSKADIHQATRALVNLNTYFQDSR
HWTQVWNSDIVKESWRDLWLTQEMPNTIPSAQWFHTELPTLGTLDVALELWYRYLFIFSIPIPEQIPSVFQASHHSVSAS
YGVVCKIKRNCTLQIWDHAISWRETNLCLSSALCKLSPFVRNALLGLMRITSVITLHHADIISPCADFFNPGWEVEIGTC
QGTIEHRNIFRRKVDPVVNGITDMQKFAPVKEIKSQRPTVTMLSHVWYAKDIKTALLAADIIINQWKFDDYHLDIYGAID
KAPTYSTECQEIIASKGLRGRVTLRGSADPMKVLENTWLFLNSSLSEGLPLALGEAALTGAPVVCTDVGASLRVLSDPDD
FSRFSAVVAPNDALALARAQITMLALLGEWAQYADDTEPAPVLTSSPTPDDVAKITRRMYEKAEHRRKLGMMTRNIVQKS
FSGDRYLREHEQMLWIGKAVKTMAVRAAAGAPGTALGDPIDIADALQVADPIEEEVITIPQSAVHSWRSSAASGMSTVYS
TISGYPMLPLTRPASIRSSFSNFSTATDSDSFMGLPSNASLPVFAPRQTLSFDAGGAVTPTGRLSPSGRLSPAFGRHRHS
HARSISTLGREQLRGLQREEPHPYRNSDVSLHMREEFLQSSIFKSIDGNAGGKS
```

Fig. 73
BASE SEQUENCE OF NUCLEIC ACID MOLECULE OF Aspergillus fumigatus gtb3(Genbank accession No. AFUA_3G07860)

ATGGACCAACCAGGAGATGCAGCCAGGATGCATGGTCCTGCTGTACATCCACTCTGCCAAGCTCGGAGGAAACGAAAGCT
GCTGCTGTCTGCTCTCAACCGGGCACTCCTCCGTGGACTGCTTTCCTTAACGAGGCTTGTCCGCGATGGAATGGCTGCCA
CGCTGTTGACACCGTCGTTCTGGTCCAGCAGGATAGCAGGATTCAGTAGACTCTTCTTAGTCCGGGTGCATGCCTGTCAA
CCAGACGTATTCTCGGCTGTAGTGACTCCAAGGCGGTTTCATCCGTTGGGCCAGAAACACACACTTCTTCTTAGCGCCAT
CTTAGCGCAGACAGGACAGACAGACAGACAACAACGAAGCTATTTTTGTCTTCATCAGCGTGCTCTGCCGAGACAGACGG
TCCATGAACTAAGCAGTTGCTGGTTGGTCGAGAAATTTCAACTGATGGATTGCGCAAAACCCAATAAAGCCCGTCCTATT
ACTTGCTGCGAACTAGATTCTCCGAGGGCCCTTATGATCTCCCCTCGCCACTGGGTTTTTTTTGAGTCGGAGCCGCTAAC
GGTTGGCCATCACCGACCGCTTTTTTTGCTTTTATGAAGGCAAACGTCAAGTTGTAGTCTATAGGCTGGTAGATGTACAT
GCTGGGTTTGCTGTGTGTGTGACATCTGGCGTGCCAGCTCTTTGACCTGCGTGTTGGCCTGGTCGATCGATCGTCCGTCC
TATCGTTTCTTTTGCCCTCGTTCGTCCGTCCGTTCGTTTGTTTCTAATCTATCTCTCGATCGATTTCGCTATACTCCGCT
CGTTTATGCAAGAATTCGCCTCCGGGGTCGATCCATCCGTGACTGGTGATGGTCTTTTAGAGCGGATTGTCTCTCTGTTGG
TGTACATTTTTGGGCTCTCCGAGTCGCCTGCCTGGTCTCTCGCTTTTCGACCTTCCTCGTTTCCATGTCCGTCTCTACTC
CTAACTTCTAGTCTCTAATCATACCATCATGGGTTTTATCGTCGCGACTACCGACGATGATGATGATTTTCAGAGGCCTC
GTCCCGTCGGATGGGCGGCATATGACAGATTCCTGGTGGCAATTTGTATGGAGTCTCTCCTCAAGCCTCGTGCTTTACTAA
CCGAGTATAGGTCCTCATCGGCTTGCTGCTAGGTAGCGTAGTGATTGGATGTTCATACCTCCTCTACGCAGGTCTGTCGA
GAGCTCGCAAATGGTACCAGGTAGGTATCCGGTCGATGTCCTCGGTCGATGCCCTCGAGGAGATTGCTGACATTTTACAG
TCGCGGGCCCAATCCGCAGTGGTGCCCAGAAATGTCTTGGATAGGCTGGACCGACTATCAAGGCAGCAGCTGTCCTTGCC
CAATGTCCAGTGGGCCAAGAAGCCGTCGTCGTTCGGCGTCTACTTGGGCTCTTTCGACGCATCCCCAACCAGGGATCAGT
CGAGACTCCTGAGTCAATGGGATCTGCTGATCGTTGACCCCGCGCAGTCCGGTGTGGTCGAGGCCCTCTCGCGGGCCGAG
AGGAAGCAGTTTCTGGGCCGAGTAGACGTCGGTTCGGGCTCAGGGTCGACTCTGGCGGCTATCGACCGAATCGAGAGCGC
ACTCAGCAGGTTCGATGGCGCGCCGTTCAGCGGCATGCTCCTGGCCAACTGGGAGAGCAGCTTCAACCCGGCCGCCATCA
GGAAACTGGCCGAGGCTCTCCATGCCTTTGGCCTGCCCGTGTATCTGGAGACAGCGCCCCGGACTTCCTCCAGGACCAT
AAGACTCTGCAGACCGATGCCATCGCCGGTCTCGTCATCCGCAATGCCTCCATCATGCCTGACGGCGAGAAACGCGACTA
CTTTCAGATGATCAAGATGCAGCCCACCATCAAAGCGTTCGTGTCGGAAGCCTGCATGCGCGACTTCGTGGTCATGGCCT
GGGAGACGGTCGACGACAACGCTCACCTGTCCAATGCGGTCATCGAGGCGATCTCTGCAGTGGTGCAACTTCTACAGCGCC
ATCACCTGGATCGGCCGCCAGGCGGCCTTGCACGATGCCTCTCTCAACGTCAAGATTCCCGAGCCCTTGTCGGCCTTTAG
TTGGCTGAAGGAAGCCGAGATCATGAAAGTCCACGACATCTGGCGCGCCAATCTGAACCTCCAGGAGGAGGAGGTCGGGC
CCAGAGACGCATGGACCGCTCTGCTGCAGTACTTTCCCACGCTTTCCAACGTGCTCACCTCGTCCGAAAGAGAGCCCCCC
TCGCACATGGACAGCGCGACGATCGCGGTTCGTGATCCGCCGGAATGGGTGGCCCAGGTCAGGTCGCAGGGCAGCCCGCT
GTCCATCTCCATGGCCGGCGTGGAATACAAGGAGTTCGGCTGTTTCCCCCTGGGATCCGAAGCCACCGCCGTGGCCTTTG
TCGAGATCCTCAAGTCCCAACAGCGGCTGAAGTCTCTGGGACTGCTGCACCCGGTTCCCTCGGACAAAATCCAGAAGCTG
GGCGCCCTCCTGCCGACGATTCCACGATAAATTCGCCGTGTCGCACTGGCCCGACTTGCCCACGCTGCCGGCGACGATCAA
GGACCTCGCCAATTTTTGCCTCCCAGGATTCCCTGCGCATCAATCTGGGCCTCGACTCCGGTCTGCGCAAGAGCGCCGACG
TCCGCTTCTGGGCCGTCTACCAGTCCGACGCGGACGGATTCGAAGTGTTTGCCTCGAAAAGCGCGCAAGGCCTCGCGGGC
ACCGTGCTGCACACGTTCCTCTCGCGCGCGAGGTTTCCCCCGTCATGTCTGCTTCGAAGCCGAGACGGCTCTGGCGCAATG
GTCCAAGGACGTGAACGAAGACATCGGACTGCCCCGCCGGCTCATCCAAGATGTGGACGCCCTGAGTCCCGAGGAGCGAT
TGCTCCTGCTGCAGCATCTTTCGTTGACGGACGCCAAGAGTGAACTGTCGGAGACGATCTGCCGGTACATCCGCCGGCAG
GTCATCGATGCCCCGTCCCTGGCGCAGCTCAAGGAGCTCAACACCGTCGCGTAGCCTCGACGGATCCCTCCCGCCAGAGGC
CCTGATCAAGTCCCGCATCCACTGGTACCGCGATCAGGGGTGCCGTTCTCCTGCCCCTGCCGCGTGCCTGGCCCTGTTCC
AGGAAACGGACGCTGTCTTCACGCGCATCCTCCGGAGAACGCCGCGAGAGCGATCTGGCTCAGATCACCAACGCCCTGTGC
CAGCTGGTCCAGAAAGACCGGATCGACGTCTATGCCGATATCCTCACGCTCTCCCTCTTCTGCGCCGCCCGCAAAGGCGC
CTTTGACGAGATCTACATGGAAGTCACGGATCGCAACCCCCTGTTCAACGACCAGTCCGATCAAGCGGCCGCCTTCGCCG
AGTCGTTTGCGCTTGGGTCGCGCTGCGAAGCCTACTTCGACCTCTCGCCCCAGCGCCTTCGGGAAGTTGCTCTCGGGTCGA
TTCAGACGATACTACCAGGACCGGGAACTGCCGGACTGGATCAACGGCGCTCCGCAGATGGCGACCTCGTATGCCGGGGC
ACAGATCGATGTCAACCCGGACGACAAGGTCAAGCCCATGCGGGGGTACCAGCGCTTCACCTTCCTCAGTGTCTTTGCGG
TGCCCGCCCTGATCGACATTCTGCTGCTGACGCTGTATGGCCGCGGCTTGTACCTCTCCGGCCACATGCCCGAGGAGGTC
ATGCACAGTGCGTCCATCGCGCTGATGATCTCTCTGCTCCTGTCGGGTGCGGCGGGCACCTGGATCGCCTGCGGCGGGTC

Fig. 74

```
CTACTACCTGATCTCCATGGCGTTTGCCGCCACCAACATGTTTGTCTTTATCCGACTCATCGCCTGTTTCGCCTTCACGA
TCGCCGTGGGGCTGGTGGGATTCATCGTCATGTCGGCCGTCAAAGGCCCCGGGCCCGGCATCGTCTTCTACCTCTACCTG
ATTGCCCTGACCCTCTACTTCAGCATCTTCGCCTCGCTCGCCTGTTTCAGCTACCCGGGCTCCAAGTTCCTCTCGGGCCG
CAAGGCCATCTTCGCCTGCATCCCCGTCCTGTTCATCTCGCCGATCGTGACCAACTGGAGCCATCACGATGTGGTCATCT
ACCTCATTGTGCTCTACATCTTCATCGGACTGCTGCTGCTCAGCCTGCGGTCCGTCGCCTCCAAATGGGTTACCTGGTAC
CAGAACATCCGACGCACCGACGACACCGAGATCCGCAAATGGTATGTGTCCAAGTACGGCAACAACGACGAGAAGTGCTT
CGGTGGCCGGAGCGATCCCGCCGTGCTGAAGCTGTCGCGAGAAGCGCTGTATCGGGACGTGATGGCCGAAGTGTCCCGCG
GCTTCTTCTCCAAGCCGACCACAGACCAGCTGGTCCTGGAACTGGCCCGGGACTGGGAAGCGACCAATTTCCTTCTCGAC
TGGTACTGCCGGTATGCCGACGTGCCCCGGCCCATCCCCTTCAGCTCGGGCTGGAATATCCAGACCAAGGTCGGGCTTGA
TGTGCTGCGCAATTCGCAAAAGGGCCAACGCTTGCACAATGCGTTCATGCATTGGCGCCAGTCCAGCCGGGAGATCGGCT
GCGGGGTGCTCTACTTTGTCTTGGCTCTGCTCGATAAATGGGCCGACTTGCTGACCGGGGGCCGGATGACTGGGTTTCTA
CAGATGCCCAATGGCGACACGCGTTTTGCGGTTGGGTTCGGCCTCGCGTATTACCTGATCGGGCGCCGTGCTCATCGACAC
CAAGGCTCAGGAACTCCATGATCTCATCGGGGGCCAGACCAATCAGGCGGTGGGCACGTCCAAGGAGATTCGGCCGTCGC
AGAAGCGCGCCGTGAGGTTCAAGAGAAAGGTGTACTGGAGGACGTTCGTCAAGTATCTCATGTGGCAGGTCTGGAGTCTT
GCCTTGTCCACGGCCTTGCTCTGGACGTTCCGGTCGTCCGTGGATGCCATGGCCATGTTCTGCGCCTACGTGCTGTCGTA
CACCGGCCTGCTGTGGTATCAATACACGAAGATCTTCGCTGGTCCGCATGCCCTCCGACCATTGCTGGCCGGGATCGTCG
TTGGCCTGCCCGTCGGGATCGTCCTCAAGACCTGTGTGTCGGGCAATTTCAGCAATTACGGCCCGGTGATTGGACTGGGC
ACCGCCACCTGGACGACCGCGATCCTCACTCTGCTCACGGCGAAAATGGGAATGCCGAAGAAGGTGGACTCGCCCGTCGA
CCTGGGCAAGACGTTCCACGCGTACACGACCCCGTGGGCGGATCCCGAATGGTCCCAGCAGGAGCTGCAAACCTTCTTCG
AGAGAATCTCTCTGGTGCCGTCCGACACGCGACTCAAGCTGGAGCCGGGTGCGCATCCGGGGATGGAAGTCAAGTCGCTG
CTGCTCTCGCGCCGCGAAGAACCGCGAATCGAGGAGGCTTTCCCCAAGGCATCCGAGCTGATTCACCGAGCCCTGCAAGC
CTGGGCCCAGGGGGAGATTTCGATCGAGCTCGTTCCCTTGGGCTCGCTGGGTCCCGGCATCCGCGCTCTTAGCTGCCATG
CCGCGGACCAGCTGAAACTGGTCCTGGCGGTCGGACGCGGACTGGACCAGCGCATCGACGTGAGCGGCAACTGCCAAGTC
ATCGCCGAGACTCTGCTTCATGCGGTGTCCGAGTCCATGCTGCGGATGCCTCACGAGTACGCCGTGCTCGCGGAATCGCT
CGTCACGGCCGGCGTGACCGAGACCATGGCCCGGCAGCTTCGCGAAGAACCCAACACCCCGGTAGTCGTGCGGTGGGCCA
AGAAGGAGCTCCTCCGGGAGCTGTGTCTGGGGTTCGAATGTGACACGCATTGGGAGAAGCTGCCCAAGACGATCCGGAAG
GCGTTGCTGGACCGTTGTGTCGGCAAGCCGTCGCACTTCTCGGAGCGCGACCGGCAATGGCTTCAGGAGCACCTCTGCCG
CTTTGATACCAGTGATCTGGATGTCCATGTTGCCCGATGCAACCTGGGCGCCGCCACCGCAGTCAGCATTCTGGATTACG
CCCACTACGGCACCGGCGAAGAGGCCTTGGGCAAGGACTCCGAGACGCCGCTCGTTCATTCCCTATGTGTCCAAAAAGCTG
CCCGCGGCGCTCGCGTTCGTCAAGGATCCCCTGCACAACTTCTGGTACTCGGTGGCGTCCGCCATCAAGTTCATCATCAT
CGCCTTGATTGCCGATCCGGAATTCCAGCGAGAATTCGACCATGTGATGAAACAGCGGCGCCCGCATCATCCGCGTGCCGT
GTGTGTTCCTCCTCAACCTGATCTGGTCGTACTCGAAGATCGTGCAGGATGTGATCCTGTCGTTCTTCCTCTTCCATGGC
CGGGACAACGTCAAGCGTCTCTGGGACGAGACCAAGGGCATGACCATCAGCATCAAGAAGAGCCGATTCATGCTGCAGAG
CCTCGACGGCACCTTTACGGCGTTCAAGCACGACGACGAGGACGGGCGGCTTCAAGGTCTACTACTACAGCGGCGAGCACA
AGACCGAGCCCGAGGGCACCAAGTCGCTCAAGTACGTCAGCACGTACTCCAAGGACACATGCTGCTGCTCATCCGGCAGGAG
TTCAAAGACGGCAAGGCCATCAACGAGTTCCACTATGACTACCGCGCGCCGAACAAGAAGAGCCTCCGGTTGACCCGCGG
CTCCGATACCCGCATCCCCCTGGGCCGGCGGTGCATCCGCGGGCGACAGCCATCTGCAGAGCGTCCAGTATAACCGCAAGG
GTCTCATCGAGGCCGGTTCCTACATGAAAGATGGCAACCTGATCCGGTTCAAGTACCACTACCGGAAGAACCCCCGGTTC
GGCGACGAACTGCTTCGCGCCGAGTTTGTGCTCTCGCACATTACCTGCACCGTCTCCTGGTGTGCGCCTCCCGTGCGGCA
TCCCGAGAAGGTCGAGCGCTGGATCCCGCACTCCAAGGTCACCGAGGCGACCTTCGTGCAAGGCGCCGACGTCTACGAGG
CTCGCTGGCTGTACGACCACAAGTTGCACCCGACCATCTTCACCACGGCTCAACGGGCAGAAGATCCAGACGCCGCCCATG
ATCGAGCATGACTTCCTCGGCGTCCTGGCCAAGCCCAAGTACACCAGCTTTGTGCATGACAATCCGCTCTTCTACTGCGA
CAGTCTCAGCTCCAACGCCATCACCCGCTTCCTGGGCCTCTCCACCAAGCGGTTTCCCGTCTCGACCTCGCGGGCCCGCT
CGCTGGTCTGGAAGGCGTGGAAGGACCGCGTCGACTTTGACGGCATCATCGTCCGCTGGATGGACGAGCGGCTGCTGCGC
CGCGACAAGACGCTGGCCCCGTACTGGCGCAGCCGGGACCGGGGCGATCTGGCCTCGGCGAAGAAGTACCTGGACCTGCG
CGCGGACACGGTCATGGCGAGTGCCGACCTCGACGACAACATCTCCAGCTGGACGCCCATGGCGATCAAAGTCAGCGATC
TGCTGAACTTTGGGCCCGGCGGCGATGCCGTCGTCAACACCCGGTCCAAGGATTTCGGGTCGGACACGGACAAGTCGCTG
CACGTCATGGCGGCCGACACGGGCACCTGGCCGAACGAGGGCGGTTGGTGTGTGCGGCCTGTCGACGCGACATGATCAACTC
CCTGCGGACGATCAAGTGGCACATGATCTGCGAGTCGGCCAACGACTTTGGCATTCCCAAGCATCAGACGGAGCAGAACG
TGCTCTCGTTGAAGATGATCCCGCTGTGGGGGCTGGACTTTTTGACGCCGACGCATGGGCTCTTCAAGAACAAGCTGGAC
```

Fig. 75

```
TCGGAGGTGGAGAACGTCACGTCGGCCAACGACATGGACATCAAGATGAACTTCATCCCGATCCTGACAGCGCTGGTGAA
AGGCGCGCGCGCCATCGAGCTGTCCAAGGCCGATATCCACCAGGCCACGCGGGCGCTGGTCAACCTCAACACGTACTTCC
AGGACTCGCGGCACTGGACGCAGGTCTGGAATAGCGACATCGTCAAGGAGAGCTGGCGCGACCTCTGGCTCACGCAGGAG
ATGCCCAACACGATCCCGTCGGCGCAGTGGTTCCACACCGAGCTCCCCACCCTGGGGACGCTCGACGTGGCGCTGGAGCT
CTGGTACCGCTACCTGTTCATCTTCTCGATCCCCATCCCCGAGCAGATCCCCAGCGTGTTCCAGGCGTCGCATCACAGCG
TCAGCGCCTCGTACGGGGTCGTCTGCAAGATCAAGCGGAACTGCACCCTGCAGATCTGGGACCACGCCATCAGCTGGCGC
GAAACCAACCTCTGCCTCTCCTCGGCCCTGTGCAAGCTCTCGCCGTTTGTCCGCAACGCCCTCCTGGGCCTGATGCGCAT
CACCTCCGTCATCACCCTCCACCATGCCGACATCATCTCGCCGTGTGCCGACTTCTTCAATCCCGGCTGGGAGGTGGAGA
TCGGCACCTGCCAGGGCACCATCGAGCACCGCAACATCTTCCGCCGCAAGGTCGACCCCGTCGTCAACGGCATCACGGAC
ATGCAAAAGTTCGCCCCCGTCAAGGAGATCAAGTCGCAGCGGCCCACCGTCACCATGCTGTCGCACGTCTGGTACGCCAA
GGACATCAAGACCGCCCTGCTGGCCGCCGACATCATCATCAACCAGTGGAAGTTCGACGACTACCATCTCGACATCTACG
GCGCCATCGACAAGGCCCCGACCTACTCCACCGAGTGCCAGGAGATCATCGCCTCCAAGGGCCTCCGCGGCCGCGTCACC
CTCCGCGGCAGCGCCGACCCCATGAAGGTCCTCGAAAACACCTGGCTCTTCCTCAACTCCTCCCTCTCCGAAGGGCTCCC
GCTCGCCCTCGGCGAAGCCGCCCTCACCGGCGCGCCCGTCGTCTGCACCGACGTCGGTGCCTCCCTGCGCGTCCTCAGCG
ACCCGGACGACTTCTCCCGCTTCAGCGCGGTCGTCGCCCCCAACGACGCCCTCGCGCTCGCCCGCGCCCAGATCACCATG
CTCGCCCTCCTCGGCGAATGGGCCCAGTACGCCGACGACACCGAGCCCGCCCCCGTCCTCACCTCCTCGCCCACCCCGGA
CGACGTCGCCAAGATCACCCGCCGCATGTACGAGAAGGCCGAGCACCGCCGCAAACTCGGCATGATGACCCGCAACATCG
TCCAGAAGTCCTTCTCCGGCGACCGCTACCTGCGCGAACACGAGCAGATGCTCTGGATCGGCAAGGCCGTCAAGACCATG
GCCGTCCGCGCCGCCGCCGGCGCCCCCGGCACCGCCCTCGGGGACCCCATCGACATCGCCGACGCCCTCCAGGTCGCAGA
CCCCATCGAGGAAGAAGTCATCACCATCCCGCAGTCCGCCGTGCACTCCTGGCGCTCGTCCGCCGCCTCGGGCATGTCCA
CCGTCTACTCCACCATCTCCGGGTACCCCATGCTCCCGCTGACCCGGCCCGCGTCCATCCGCTCCTCCTTCAGTAACTTC
TCCACCGCGACCGACTCGGACTCCTTCATGGGCCTGCCGAGCAACGCATCCCTGCCTGTCTTCGCGCCGCGGCAGACCCT
CTCATTCGATGCGGGCGGGGCCGTGACGCCCACGGGTCGGCTGTCCCCGTCAGGCAGGCTGTCGCCGGCGTTTGGGCGGC
ACCGACACTCGCACGCGCGGTCCATCTCCACGCTGGGCCGCGAGCAGCTGCGTGGTTTGCAGCGTGAGGAGCCTCATCCG
TACCGCAACTCGGATGTCAGTCTGCATATGCGCGAGGAGTTCCTGCAGTCGAGTATCTTCAAGTCTATCGACGGTAATGC
GGGGGGGAAATCCTGA
```

Fig. 76
PUTATIVE AMINO ACID SEQUENCE OF Penicillium chrysogenum AgsB (Genbank No. Pc16g06130)

MKWSLASGLVSLLVTTVTAWPYDEAYLDYNINTNKTATNPADYWGTWPGHEGKYFPSPDNWRFPFYSMFLDRFVNGDPTN
DNANGTTFEHDIEHRIRHGGDVAGLVDTLDYLQGMGIKGIYITGTSLLNMPWTSDGYGVVDTTLLDAHFGTIQAWRDAIT
EIHKRGMYVLFDNTIATMADLIGFEGHLNKSTPFSEKEWPALWKSERRYRDFDIKEGHYNASCDYPRFWYEDGYPVNESQ
TAGLVGCYDSDFDQYGDIEAFGVWPDWKRQLAKFASVQDRLREWNPSVRERLIRHSCMIIHSFDIDGFRYDKATQATVDA
LGDMSAAYRECAREVGKENFFITGEITGGNDFGTIYLGRGRQRNQYPENSAVTMNLTNTSSAQYFLREAGHEAIDSAAFH
YSTYRALTRFLGMDGQLTAGFDAPVDWVEGWDYMVKTNDLINANTGVFDPRHMFGATNQDVFRWPAIANGTHRQLLGTFV
GTLLLPGIPLLLWGEEQNFYILDASAENYIYGRQAMSPATAWMTHGCFQLDSSQYYKWPITAGREGCHDITVSYDHRDPS
HPVRNVMRHMFQMREHYPVLNDGYSLGSLTKQTEWVHYPGSNETATETGMWSVYRDVNAVLQEDLALNPDSIPVWLVYTN
LNDTMTYNFDCKSKNPNKTLTAPFDAGTTVKNLFYPYDEITLVEGAQKLGLNGSKEMNGCTESMEMKAYEFRAYVPKNKH
KSARPMITKFTPGHDFPLRSTVAPDLPEDVTVELYFSEEMNCDLVTDAITFNSSTEKGQVPTIDPKTVNCTTIPPLLQSN
WTAEIPSVWKWTANLTGVYNGVHKLTVNNATNTDKSDSTNAIDHFLFRVGQFDNPMVFITANYSSSLLHRRENGDLFIQH
HAAGADKYRYSTNWGSSFSDWRDYKGGNDTIDKLPWSGTKDQEWDGEHVRVEYWSRLTGSSDYVQQGDLDWNHPVTRRFP
HAFFNGPYNQYGYDAGLDNRIRLDTRTGVWSYHFTSEWPAVGQLNIWGINPDGKPDQTWVLGDIDNDTILDRSPPSSLSA
TVINITAAPAKGYLSHKLYFDDGTLHFWLDPVGPQSTQIVMFILFWIIPFITAVGCVYIFMKSFYKVKFNEVGVTEKQNI
PLAIWNKIKPSRRDQSSNPLMRLANKSGFMQSTSALGGALASGKRRMVLIATMEYDIEDWAIKIKIGGLGVMAQLMGKTL
GHQDLIWVVPCVGGVDYPVDQVAEPMTVTILGSPYQVQVQYHVLNNITYVLLDAPVFRQQSKTEPYPARMDDLDSAVYYS
AWNQCIAEAIKRFPIDTYHINDYHGSLAPLYLLPRTIPACLSLHNAEFQGLWPMRTIKEKQEVCSVFNLEEDIVRRYVQF
GEVFNLLHAGASYLRVHQAGFGAVGVSKKYGKRSYARYPIFWGLHKVGNLPNPDPSDVGEWTKEPTKEEDITVDPTYEAG
RGELKRQAQEWAGLDQNPDADLLVFVGRWSMQKGVDLIADALPAVIEARPNVQLICIGPVIDLYGKFAALKLDHMMKVYP
GRVFSKPEFTALPPFIFSGAEFALIPSRDEPFGLVAVEFGRKGALGIGARVGGLGQMPGWWYNVESVSTSHLLIQFKLAI
EAALNSKTSVRAMMRARSAKQRFPVAQWVEDLEILQNTAIQVHIKEASKTHSTNSTRPGTSSGFSTASAAMSPSMNQLGS
PLPSPGINSPFTHSRESSYSFNQMNSLGTQKKVSYSADPDQEETEKPKSGLSRSLSLGVRSGPGHAGRRRRAAEGGIPES
DENGATDVDENSDEEAAHNAFDDDEYTLTPAQVEAGRRAQAAQRDRAQNLPSPSRRPSQDSLQPRFMVPLESPRSPGTPP
AVDSLLLPPQPFAESNRLSSASVLSLDSVVGNKTDYKLQKVDPFFTDQTGEYYRIFDKKLDVLNGSNSESQLCIEEFLIK
SEQEWFDRFRNARLGRNKSPTPSIRHSSRNTATPDTMFYNDDLASNVNSDEDNHLQDDEFLLGKDYVPPTGLKKWMQVKI
GDWPIYSMFLALGQIIAANSYQITLLTGEVGQTAEKLYGIATTYAIASMCWWLVYRYFKSVVCLSTPWFLYATAFLLIGS
AHWEGDSFTRGWIQNVGTGFYAAASASGSIFFASNFGDEGGAPVKTWIFRACVIQGIQQAYVIALWYWGSTMTKASSEGL
LNPETNIANSWKMSAICYPICIFLCIVGVLLAMGLPNYYRQKPGKVPSFYKSLFRRKIVTWNFIAVILQNFFLSAPYGRN
WSFLWTSIHTHAWQIVILCIVFFGFVWCIFLFVVSRFSKRHSWFLPVFACGLGAPRFIQIWWAVSGIGYYLPWAGGYTSG
ALVSRSLWLWLGVLDSIQGLGFGIILLQTLTRVHMCFALIASQVIGSIATICARAFGPNNVGPGPISPDMTQGAHSLANG
WFWVALFCQLLVCAGFLLFFRKEQLAKP

Fig. 77
BASE SEQUENCE OF NUCLEIC ACID MOLECULE OF Penicillium chrysogenum agsB (Genbank No. Pc16g06130)

```
ATGAAGTGGTCACTCGCTAGCGGGCTGGTCTCACTTCTTGTGACGACCGTCACAGCTTGGCCCTACGATGAGGCCTACCT
GGATTATAACATAAACACAAATAAGACGGCCACCAACCCGGCAGATTACTGGGGAACATGGCCTGGTCACGAGGGGAAAT
ATTTCCCCTCCCCGGATAACTGGCGCTTCCCGTTCTATTCTATGTTCTTGGATCGCTTCGTGAATGGTGACCCTACCAAT
GACAATGCAAACGGTACCACCTTCGAGCATGATATTGAACATCGCATTCGCCATGGTGGCGATGTGGCTGGTCTTGTTGA
CACACTGGATTATCTCCAAGGAATGGGAATCAAGGTTTGTCTCATCCGAATTGTCTAATGGCAAGAAAATATATGCTCAC
AATGTCCAGGGTATCTATATCACGGGAACCTCCTTGCTGAACATGCCGTGGACTTCAGACGGATATGGAGTTGTGGATAC
AACGCTTCTTGACGCCCATTTTGGCACAATTCAAGCTTGGCGAGACGGCCATCACCGAAATACACAAGCGCGGGATGTACG
TCTTGTTCGACAATACCATTGCGACGTAAGTTGTCTCTGTATGCATAGTGAATAGAGCAGAGCTAACCTAATTGTATAGA
ATGGCTGACTTGATTGGGTTTGAAGGCCATCTCAACAAATCCACCCCATTCTCGGAGAAGGAATGGCCAGCACTATGGAA
GAGTGAACGCCGATACAGAGACTTCGACATTAAAGAAGGTCACTACAATGCGAGCTGTGACTACCCTCGATTCTGGTACG
AAGACGGATACCCGTGAATGAATCGCAGACCGCAGGTTTGGTTGGATGTTATGACAGCGACTTCGACCAGTATGGTGAT
ATTGAGGCTTTCGGTGTTTGGCCCGATTGGAAGCGACAACTGGCAAAGTTCGCCTCCGTCCAGGATCGTCTACGTGAATG
GAACCCGAGTGTGCGCGAAAGGTTGATCCGACACTCCTGTATGATCATTCATTCTTTCGACATCGATGGTTTCCGCTATG
ATAAGGCCACCCAAGCTACTGTGGATGCCCTTGGGGACATGTCCGCTGCCTACAGAGAATGCGCGCGCGAGGTCGGGAAG
GAAAACTTCTTTATCACTGGCGAAATCACGGGTGGAAATGACTTTGGTACTATTTACCTCGGAAGGGGTAGGCAGAGGAA
CCAATACCCTGAGAACTCGGCCGTCACAATGAACTTGACAAACACGTCCTCTGCCCAGTACTTCTTACGCGAAGCGGGCC
ATGAAGCCATTGATAGTGCGGCCTTCCACTACTCGACCTATCGTGCATTGACTCGGATTCCTCGGCATGGACGGACAACTC
ACGGCAGGCTTTGACGCGCCTGTTGACTGGGTTGAGGGCTGGGACTACATGGTGAAAACAAATGACTTGATCAATGCCAA
TACCGGCGTGTTCGACCCTCGACACATGTTTGGTGCGACTAATCAAGACGTCTTCCGCTGGCCAGCGATTGCGAACGGCA
CCCATCGACAGTTACTCGGTACTTTTGTGGGTACATTGCTGCTCCCCGGAATCCCGCTTCTCCTTTGGGGAGAAGAGCAG
AATTTCTATATCTTGGATGCCAGCGCGGAGAACTACATTTACGGGCGACAGGCTATGTCGCCTGCAACTGCGTGGATGAC
CCATGGCTGCTTCCAATTGGACTCCTCCCAGTACTACAAGTGGCCCATCACGGCCGGTAGAGAGGGCTGTCATGACATAA
CAGTTTCTTACGACCACCGCGACCCCTCCCACCCTGTCCGAAATGTTATGAGGCATATGTTGCAGATGCGCGAGCACTAC
CCAGTTCTCAATGACGGGTACTCCCTTGGCAGCTTGACAAAGCAAACCGAGTGGGTTCACTACCCTGGTTCCAATGAAAC
GGCCACGGAGACCGGAATGTGGTCTGTTTACCGGGATGTCAACGCCGTCCTGCAAGAAGATTTGGCCTTGAATCCTGACA
GCATTCCAGTCTGGCTTGTTTACACAAACCTCAATGACACAATGACATACAACTTCGACTGCAAGTCCAAGAATCCGAAC
AAGACACTGACAGCGCCATTTGATGCTGGCACCACTGTCAAGAACCTTTTCTACCCGTACGATGAAATCACACTGGTAGA
AGGAGCTCAAAAGCTTGGCTTGAATGGATCGAAGGAGATGAATGGCTGTACGGAAAGCATGGAGATGAAGGCATACGAGT
TCCGCGCATACGTCCCTAAAAATAAGCACAAGTCAGCTCGGCCCATGATCACCAAATTCACTCCGGGGCCATGATTTCCCA
CTACGCTCTACCGTGGCGCCCGACCTTCCCGAGGATGTGACAGTTGAACTTTACTTCTCGGAAGAAATGAACTGTGACTT
GGTGACTGATGCAATTACCTTCAATTCATCGACAGAAAAGGGGCAGGTCCCAACCATAGACCCCAAGACTGTTAATTGCA
CAACCATCCCTCCCTTGCTCCAATCAAATTGGACTGCTGAGATACCAAGCGTTTGGAAGTGGACAGCAAACCTGACTGGA
GTTTATAACGGAGTTCACAAGTTGACTGTCAACAACGGCAACCAACACCGACAAAAGCGATTCTACCAACGCTATTGATCA
CTTCCTCTTCCGTGTCGGTCAGTTCGATAACCCTATGGTATTCATCACTGCCAACTACTCGAGCAGTCTACTCCACAGAA
GAGAAAATGGCGACCTTTTTATCCAGCACCACGCCGCTGGTGCAGACAAATACCGCTATTCTACCAACTGGGGATCGTCA
TTCTCTGACTGGAGAGACTACAAAGGTGGAAATGATACTATTGACAAGCTCCCATGGTCGGGAACCAAGGATCAGGAGTG
GGATGGTGAGCATGTACGTGTCGAATACTGGAGTCGCTTGACCGGAAGCAGCGATTACGTGCAGCAAGGTGACCTTGACT
GGAATCACCCAGTCACACGACGCTTCCCCCATGCTTTCTTCAACGGACCGTATAATCAATATGGATACGATCGGGCCTA
GATAACAGAATCCGGCTCGACACGAGAACCGGGGTCTGGTCCTACCATTTCACCTCCGAATGGCCTGCAGTCGGACAGCT
CAACATCTGGGGAATTAATCCAGACGGGAAGCCCGATCAAACTTGGGTTTTGGGAGATATCGACAATGACACAATCCTGG
ACCGAAGTCCTCCGTCTTCTCTGAGCGCGACTGTGATCAATATCACTGCAGCGCCGGCTAAAGGCTACCTCTCCCACAAG
CTATACTTCGACGATGGAACTCTCCATTTCTGGCTTGATCCGGTTGGACCCCAGTCCACACAGATTGTCATGTTCATTCT
ATTCTGGATCATACCATTCATCACTGCCGTGGGATGTGTGTATATCTTCATGAAGTCATTCTACAAGGTCAAGTTCAACG
AGGTCGGTGTGACTGAGAAACAAAACATCCCCCTCGCAATTTGGAACAAGATAAAGCCCTCCCGTAGGGATCAATCCTCG
AACCCACTCATGCGCTTGGCCAACAAATCTGGCTTCATGCAAAGCACCAGTGCCCTAGGCGGGGCCCTTGCATCTGGCAA
GCGCCGCATGGTTCTAATCGCCACTATGGAGTACGACATTGAGGATTGGGCTATCAAAATCAAGATCGGTGGTCTCGGTG
TCATGGCTCAACTCATGGGTAAGACCCTAGGTCACCAAGACCTAATCTGGGTCGTTCCATGCGTTGGAGGTGTCGACTAC
```

Fig. 78

```
CCTGTGGACCAGGTCGCGGAGCCTATGACAGTCACTATTCTAGGCAGCCCCTACCAGGTTCAAGTGCAGTACCACGTCTT
GAATAATATCACCTATGTACTGCTCGATGCTCCAGTGTTCCGTCAACAGTCGAAGACCGAACCGTACCCTGCTCGCATGG
ATGATCTCGACAGTGCAGTGTACTATTCGGCATGGAACCAGTGTATCGCTGAAGCTATCAAGCGATTCCCAATTGACACC
TACCACATCAACGACTACCACGGTTCTCTCGGCGCCTCTTTACTTGCTACCAAGAACCATCCCCGCCTGTCTTTCATTGCA
CAATGCTGAGTTCCAGGGTCTCTGGCCTATGCGGCACCATCAAAGAAAAACAGGAGGTTTGCTCGGTCTTTAACCTTGAAG
AAGATATCGTTCGTCGTTACGTGCAATTTGGTGAAGTGTTCAACTTGCTCCACGCCGGTGCAAGCTATCTCCGTGTGCAC
CAGGCAGGATTCGGTGCCGTTGGTGTTTCTAAGAAGTACGGCAAACGGTCTTACGCTCGCTATCCTATCTTCTGGGGTTT
GCATAAGGTTGGCAATCTACCTAACCCTGATCCATCTGACGTCGGTGAATGGACAAAGGAGCCCACCAAAGAGGAAGACA
TCACTGTGGATCCAACTTACGAGGCTGGCCGTGGTGAGCTTAAGAGACAGGCCCAGGAATGGGCAGGGCTCGACCAGAAT
CCTGATGCCGACCTGCTTGTGTTCGTTGGTCGCTGGTCTATGCAAAAGGGTGTTGATCTTATTGCAGACGCACTGCCTGC
TGTTATCGAAGCTCGACCTAACGTGCAGTTGATCTGTATTGGTCCCGTCATCGATCTCTACGGTAAATTCGCTGCTCTCA
AGCTTGACCACATGATGAAAGTCTATCCCGGACGAGTTTTCTCAAAGCCTGAGTTCACTGCACTTCCGCCCTTTATCTTT
TCTGGTGCCGAGTTCGCCTTGATCCCGTCCCGTGACGAGCCCTTCGGTCTGGTTGCCGTAGAGTTTGGCCGAAAGGGTGC
ATTGGGTATCGGAGCTCGTGTTGGTGGTCTTGGCCAAATGCCAGGCTGGTGGTACAATGTGGAATCAGTCTCGACGTCGC
ATCTCCTCATTCAATTCAAGCTTGCAATTGAGGCTGCCCTCAACTCTAAGACATCCGTCCGTGCCATGATGCGTGCCAGA
TCTGCCAAACAGCGTTTCCCTGTTGCTCAATGGGTTGAGGATCTTGAGATCCTGCAAAATACTGCCATCCAGGTTCACAT
CAAAGAAGCGTCGAAGACACATAGTACCAACAGCACTCGACCTGGCACTTCTTCTGGATTCAGCACTGCCAGTGCGGCCA
TGTCACCTTCCATGAACCAACTAGGTAGCCCACTGCCTTCACCCGGCATAAACTCTCCATTCACGCATTCCAGAGAAAGC
AGCTACTCCTTCAACCAAATGAACAGCCTTGGCACCCAGAAGAAGGTCAGCTACAGCGCGATATCCAGACCAGGAAGAAAC
GGAGAAACCAAAGTCCGGACTGAGTCGTTCCCTTTCCCTGGGTGTCCGCTCAGGCCCCGGTCATGCTGGACGTCGCAGAA
GAGCAGCAGAGGGTGGTATCCCAGAGAGCGATGAAAATGGAGCCACTGATGTCGACGAGAACAGCGATGAGGAAGCTGCT
CACAACGCGTTTGACGATGACGAATACACTCTCACCCCAGCCCAGGTCGAGGCAGGACGACGTGCCCAGGCTGCGCAAAG
GGACCGCGCTCAAAACTTGCCTTCGCCAAGCAGACGCCCCAGTCAAGATTCTTTACAACCCAGGTTCATGGTTCCTTTGG
AAAGCCCGAGGAGTCCGGGAACCCCCCCGGCCGTAGACAGCCTCCTTCTCCCTCCCCAGCCATTTGCCGAGTCCAACCGT
CTCAGCAGCGCATCCGTTCTCTCTCTGGATTCCGTCGTCGGAAACAAGACTGACTACAAGCTACAAAAGGTTGATCCTTT
CTTCACGGATCAGACTGGCGAGTACTACAGGATATTTGACAAGAAGTTGGATGTCCTCAACGGATCCAACTCTGAGTCGC
AGCTCTGTATCGAAGAGTTCTTGATTAAGAGCGAACAAGAGTGGTTCGACAGGTTCCGTAATGCCAGACTGGGTCGCAAC
AAGTCTCCCACTCCGTCAATTCGCCATTCATCGAGAAACACCGCCACCCCAGACACAATGTTCTACAATGATGACCTCGC
CTCCAACGTGAACAGCGACGAAGATAACCATCTCCAAGATGATGAGTTCCTTCTCGGAAAGGACTATGTCCCTCCCACTG
GGCTTAAGAAATGGATGCAGGTCAAAATTGGAGACTGGCCGATCTACTCCATGTTCCTTGCTCTGGGCCAGATCATTGCC
GCAAACTCCTACCAGATCACTCTACTCACAGGTGAAGTTGGTCAGACTGCGGAGAAGTTGTATGGAATTGCGACAACATA
TGCCATTGCATCCATGTGCTGGTGGCTCGTGTACCGATACTTCAAGTCTGTCGTCTGCCTTTCTACCCCGTGGTTCCTGT
ACGCTACTGCTTTCCTCTTGATTGGATCTGCTCACTGGGAAGGAGATTCCTTCACGCGGGGATGGATCCAGAATGTCGGC
ACCGGTTTCTATGCCGCGGCCTCCGCCAGTGGATCCATTTTCTTCGCTTCAAACTTTGGTGACGAGGGTGGTGCTCCAGT
TAAAAACCTGGATTTTCCGGCGCCTGTGTTATTCAAGGTATTCAACAGGCATACGTTATTGCCCTCTGGTACTGGGGTTCCA
CCATGACCAAAGCTTCGTCAGAGGGTCTCTTGAACCCTGAGACCAACATTGCCAACAGCTGGAAAATGAGGTAAATACAC
CTGCCCACCTATGTCCTGAATTGTTTTTTACTGACAGATTCCAGTGCAATCTGTTACCCCATCTGCATCTTCCTGTGTA
TTGTGGGTGTTTTGTTGGCTATGGGACTTCCCAACTACTACCGCCAAAAGCCAGGCAAGGTGCCATCCTTCTACAAGTCC
CTTTTCCGGAGAAAGATCGTCACTTGGAACTTCATCGCCGTCATCCTGCAGAACTTCTTCCTCAGTGCACCATACGGTCG
GAACTGGAGCTGTAAGTCCAATTCTCCCATTCCAATTTTTGCATACCGACCAATACTAACATCCCCCCTCCCAGTCCTAT
GGACCTCCATACACACCCACGGCATGGCAGATCGTCATCCTCTGCATCGTCTTCTTCGGCTTCGTCTGGTGCATCTTCCTC
TTTGTCGTTAGCAGATTCTCAAAGCGACACAGTTGGTTCCTTCCCGTCTTCGCCTGCGGCCTGGGCGCACCCCGCTTCAT
CCAAATCTGGTGGGCTGTCTCCGGCATCGGGTACTACCTGCCCTGGGCCGGAGGGTACACATCCGGCGCGCTCGTCTCTC
GCAGTTTGTGGCTGTGGCTGGGCGTGTTGGATTCCATCCAAGGTCTTGGATTCGGTATCATCCTTCTGCAGACTCTCACT
CGAGTCCACATGTGTTTCGCTCTCATTGCATCTCAGGTGATAGGTTCCATTGCGACTATCTGCGCCCGAGCTTTCGGTCC
GAACAATGTGGGACCTGGCCCAATCTCTCCTGACATGACCCAGGGCGCCCATTCCTTGGCTAATGGCTGGTTCTGGGTGG
CTTTGTTCTGTCAGTTGTTGGTCTGGTATGTTGATCTTTGCTTGTCTTGCTTGGTGGAATGCTCGCTAACGTTTATCTGC
AGTGCCGGGTTCTTGCTGTTCTTCCGTAAGGAACAACTCGCCAAACCATAA
```

Fig. 79
PUTATIVE AMINO ACID SEQUENCE OF Penicillium chrysogenum Uge3  (Genbank No. Pc20g06140)

MIEPTSFSSSRSGSPQRSDANSPVHSPIAVDTPSTEAGDPFDNLHDLLRRLPLQSHILVTGGLGFIGSHTTLELLKANYN
VIVIDNLSNAFENVVGRISLLAKKHHEENGTKMPSLRLHAHDYRDTEALQSLLEEYQLPSRWGTPKSRIAGVIHFAAYKA
VEESIRKPLKYYSNNVSGLVDFATTLGDFGIKTFIFSSSATVYGSLATSGLPLKEELCVHKEELYTDHEGSQQFIQPGCT
GITNPYGRTKWMCETILADLAASDPEWTIVALRYFNPVGCDSSGLLGEDPRQAPTNLLPVVVKVITGQYSELSMFGTDWE
TEDGTAVRDFIHVSDLARGHIAALSSANEGKLTENFRTFNLGTGKGNSVMDVVSTMESVTEKHIPRRAAPRREGDVGACV
AVVDRSTEELQWKTEKSLKDACRDICNFLDISGLSS

BASE SEQUENCE OF NUCLEIC ACID MOLECULE OF Penicillium chrysogenum uge3  (Genbank No. Pc20g06140)

ATGATTGAGCCAACATCATTTTCCTCTTCAAGGTCGGGCAGCCCTCAAAGGTCCGATGCGAACAGTCCTGTGCACTCTCC
TATCGCTGTGGACACACCGTCAACAGAGGCTGGAGACCCATTCGACAATCTCCATGACTTGTTGCGCAGACTCCCTTTGC
AGAGTCACATTCTTGTCACTGGCGGCCTCGGTTTCATTGGTAGTCACACCACGCTTGAGTTGCTCAAGGCAAACTATAAC
GTCATTGTGATCGACAATCTCAGCAATGCATTCGAGAATGTTGTCGGCCGTATCAGTCTCTTGGCCAAAAAGCATCACGA
GGAGAACGGCACGAAGATGCCATCTCTGCGGTTGCATGCACATGACTATCGCGACACCGAAGCTCTTCAATCACTGCTCG
AAGAATACCAGCTTCCATCCCGGTGGGGAACTCCCAAATCGAGAATCGCCGGAGTCATCCACTTTGCAGCTTATAAAGCC
GTGGAGGAGAGCATTCGGAAGCCACTGAAATATTACTCTAACAATGTCAGCGGGCTGGTCGACTTTGCCACAACACTTGG
TGACTTCGGCATCAAGACCTTCATCTTCTCGTCTTCCGCCACAGTATACGGGTCCCTCGCAACCTCGGGTCTTCCATTGA
AAGAGGAACTGTGTGTTCACAAGGAAGAGTTGTACACAGACCATGAAGGCTCACAGCAATTCATCCAACCTGGATGCACC
GGAATCACCAACCCGTACGGACGCACGAAATGGATGTGTGAAACCATCCTAGCTGACCTCGCCGCATCAGACCCCGAATG
GACCATTGTTGCACTCCGCTATTTCAACCCCGTTGGCTGTGATTCTTCCGGTCTTTTGGGCGAAGACCCAAGACAGGCAC
CAACAAACCTGCTTCCCGTCGTTGTCAAAGTCATTACCGGCCAGTATTCAGAACTTTCGATGTTTGGGACAGATTGGGAA
ACCGAAGATGGCACTGCCGTCCGTGACTTCATCCACGTTAGTGATCTGGCTCGTGGACATATTGCCGCGCTTAGTTCGGC
CAACGAGGGCAAGCTGACAGAGAATTTCCGCACATTCAACCTCGGAACTGGAAAAGGGAATTCGGTGATGGATGTGGTCA
GCACTATGGAGTCTGTTACTGAGAAGCACATTCCTAGGCGTGCCGCACCACGTCGCGAAGGTGACGTTGGAGCCTGCGTT
GCGGTAGTCGATCGGTCGACGGAAGAGCTTCAGTGGAAGACAGAAAAGAGCTTAAAGGATGCTTGCCGGGACATCTGCAA
CTTCTTGGATATCAGTGGGCTGTCTTCGTAG

Fig. 80
PUTATIVE AMINO ACID SEQUENCE OF Penicillium chrysogenum Sph3 (Genbank No. Pc20g06130)

MSDSEKHVSKRTCLKSKRSRFILATVALIVIIAAVVPSVVVTTLKKNSMGPKAKVFVPLYIYPAPEAWAPLENVISTHPN
VNFTVVINPGNGPGPDSLPDGNYTREIPKLTAYDNVRVLGYVHTSYGKRNFSAVRKDIQTYADWPTNSSNPNLAVRGIFF
DETPQQYDAQTLTYLQGLTDFAKNLKGLGPDQFVVHNPGAIPDSRYLATADSTVVFEAAYSTFQEREGAKLFSNIADSNR
TQLCAIVHSVPESVEGKHLRGLVKQVRKVAEEVYITHLSTDYYSSFGAKWTEFVDLMAA

BASE SEQUENCE OF NUCLEIC ACID MOLECULE OF Penicillium chrysogenum sph3 (Genbank No. Pc20g06130)

ATGATTGCTGCCCCAGTCTGGGCTTTGAAGGTCGGTTGCTACTACGCCTTTATAACATGCGACACTGCCCCCGGCGTTTG
GCCTGAGAAGACGCCGACTGTCATCACCTATCACCCTCCAGTCTCGACTCCTTCTAGTACTCCTACTAGTTCTGCTGGAG
TGAGTTCCACCACGGTCGCTACTTCTACACACTCTTTCACTTCCTCTTTGTCCTCTACCCCTGTTACCAGTTCGCCTAGC
ACGAGCACTACTTCTGTAACATCAACCTTCGTTACTTTTACCTCGTCGGGTTCAATCTCGTCCGACTCTGTTTCAGAGTC
CGTAATCGTCACTGTCCCATCTGGTACCTCCAGCGTCCCTACCCAGAGTGGGACATTGTCTGTTTCATCCAGCTCATCCG
CTATTCCCAGCAGCCTGGTCTCTTCGTCAGTCGTTTCTTCTTCGGCTGTTTCGACTGCACCTGTTTCCACAAGTGCTTCT
GTGACTACTCCTAGAATGTCGTCCACAGCTATCTCAATCTCGGCTTCTCCCTCTGCCACCTCGCTCAACCACGCTACTGT
TGCAGCTGACATTCTTGTCATTGCTAGAGATGCTGCCGCTGCAGGTGTGGCCAGCTCTGGGCTCAATGGATACGGTATCC
CATTTACCACTCTGCTTGTTCCCTCTGCTGGTGTTGCTCTTCCCGACCTCAATGGCACCGCTGGAGGAAACTTTGGTGGT
ATTGTCGTTGCCTCTGAAGTCAGCTATGAGTATGGTGGTGACGTGGGCTTCCAGAGTGCCCTGACCACGGATCAGTGGAA
CCAGCTATATGCTTATCAGCTTGAATACGGTGTCCGCATGGTCCAATATGATGTCTACCCGGGTCCCAAGTTCGGTACAT
CTGCTCTCGGTGGATGTTGTGATGACGGCATCGAGCAGCTTGTCTCATTCACTGATATTAGCGATTTCCCCACATCTGGC
TTAAAGACTGGTGCAGGTGTCAGCACCAGTGGTCTGTGGCACTATCCCGCGACTATCAGTAACACCACCTCTACCAAGCA
AATCGCCTCGTTTGGCCCCACTACAGGGTTCACTACTGAGAGCGCTGCTGGTGTGATCAACAACTTCGATGGCCGTCAGC
AGATGGCCTTCTTCATTGGTTTCGACACTAATTGGAGTGCTACATCCAGCTACCTGCAGCACGCATGGATCACCTGGATC
ACCCGCGGTCTGTACGCCGGGTACCGCCGTGTCAACCTGAACACCCAGATTGATGACATGTTCCTCGAGACTGAAATTTA
CTCGCCCGCTGGTGAAAACTTCCGTATCCGCGCCCAGGATATGATCAATATTGCCAGTTGGACGGATGAGATCAACGCCA
AGATGCCCGCCGGCAGTTCTTACTTTGTCGGAGGTCGGCCATAACGGTAATGGAAACATCGAGAACTCTTCTGATACATCG
GATGCTGGCTGGGATTCTTGCGGATCTGCTATTGAATATGACTCGCCTCCTGACACTGAGCCCGAATGGATGAAACCGCT
TGGTACTGGCACTGACCTGTGGCCCGCCGCCCCTACTGCTTATGACTGGACTAATACTTGCACTGCCATGGATGAACTCC
TGACCTGGTGGACCACCGAAAGCAACCTCAACAAGTTCGGTCATGTTTCCCACACCTTCTCACACGAGGAGCAGAATAAT
GCTACCTACAGCGATGTCTACAAGGAGATCAGTTTCAACCAGGCTTGGCTAAAAGCCGTCGGTATCGATAAGGCCACCAA
GTTCACTTCCAACGGTATCATTCCTCCTGCCATTACCGGTCTGCACAATGGCGATGCCCTTCGCGCCTGGTGGGAGAACG
GCATCACTAACTGTGTGGGCGACAACACCCGCCCTGCTCTTCTGAACAAGGAGAATGACATGTGGCCTCTCTTCACAACT
ATTGCCGCCAACAATTTCGACGGCATGCAGATCAACCCTCGCTGGGCCACTCGCATCTACTATAACTGCGACACTCCTGC
CTGTACCGTTGCAGAATGGATCGCCACCTCTGCTGGTGCCGGTACCTTCCAGGACCTCCTCGCCATTGAGAAGGCTGAGA
CCATGCGCCATCTGTTCGGCCTCTACCATGATGGTTATATGTTCCACCAGGCCAACCTGCGCAACATTGATGTTACCCCA
ATTACCATCAACGGTGTGTCTGAGAAGTACTCCATTATGCAAGCTTGGGTGGAGGTCCAGGTCCAGGAGTTCGTCCGCCT
GGCTGAATGGCCCATCATCACACTCACACACCAGGAGGTAGGATGAACCCCATCTAACATGTTACAACGCCTCATTCATT
CGCTAACTCGTCATAGATGTCCGCTTCCTTCCTTGCCCGTTTCAACCGTGACAAGTGCGGCTACTCTCTGAGCTACGCCA
CTAGCAACCAGAAGATCACCGCTGTCACTGTCTCTGCCACTGGCAATACCTGCACTGAACCCATTCCGGTGACCTTCCCA
GTTGGTCCTACCAGCACCCAGGGCTTCGCCACTGAGCAGCTAGGTGCTGACCCACTGACCGTCTGGGTTAAGCTCACTGG
ATCCCCTGTCACATTCACTCTCTCCACTCGCCATTTTCCTTTAA

Fig. 81
PUTATIVE AMINO ACID SEQUENCE OF Penicillium chrysogenum Ega3  (Genbank No. Pc20g06110)

MGEPSSKAGWWAWSTRKKVLIFGTVALVIIALGVGLGVGLGISAKNGGDDDNDNNNEGTGSNTTTPTNTTVRWQPPVGAK
WQIILKSEDEPISTSVNAPIYDIDLFDNNKTFISNLQKMDRKVICYFSAGSFENWRDDAGDFNDADKGDDLDGWPGEKWL
NVKSTNVRKIMQTRLDIAVEKGCDGVDPDNIDGYDNANGLDLTKAEAIDYVNWLAAQSHSRGLSIGLKNGAGIIDSVIDN
MQWCVNEQCAEFDECDTYAPFIEADKPVFHIEYPKGGNTNNDKSVSASQAKSACTANSSGNFSTVIKNMDLDNWVEYCP

BASE SEQUENCE OF NUCLEIC ACID MOLECULE OF Penicillium chrysogenum ega3  (Genbank No. Pc20g06110)

ATGGGTGAACCATCATCCAAGGCGGGCTGGTGGGCTTGGTCGACCAGGAAGAAGGTTCTTATCTTCGGAACCGTCGCCCT
TGTCATCATTGCTCTAGGTGTCGGACTAGGTGTCGGACTGGGGATTAGCGCCAAGAATGGCGGAGACGACGATAACGATA
ATAACAACGAGGGCACCGGTTCTAATACAACAACACCAACCAACACAACCGTGAGATGGCAGCCACCTGTTGGCGCCAAG
TGGCAGATCATCCTGAAGTCCGAGGACGAACCGATATCCACCTCAGTGAACGCACCAATCTACGACATCGATCTTTTCGA
CAACAACAAGACCTTCATTTCAAATCTCCAGAAAATGGATCGCAAAGTGATCTGCTACTTCTCTGCCGGCTCGTTCGAGA
ACTGGCGCGATGACGCCGGCGATTTCAACGACGCAGATAAGGGCGACGATCTCGACGGATGGCCCGGCGAGAAATGGTTG
AACGTCAAGTCCACAAACGTGCGCAAAATCATGCAGACGCGTCTCGATATTGCCGTAGAGAAGGGCTGCGACGGCGTCGA
CCCTGATAACATCGACGGGTACGATAACGCGAACGGGCTGGATCTCACTAAGGCTGAGGCTATCGACTACGTGAACTGGC
TTGCTGCCCAGTCCCACAGCCGTGGTCTCTCAATTGGACTGAAGAATGGCGCTGGCATTATCGACTCTGTCATTGATAAC
ATGCAGTGGTGTGTCAATGAGCAGTGCGCTGAGTTCGATGAGTGTGATACCTATGCGCCCTTCATCGAAGCGGACAAGCC
TGTCTTCCATATCGAGTACCCCAAGGGTGGTAATACGAACAATGACAAATCTGTGTCGGCCAGCCAGGCGAAATCCGCTT
GTACGGCCAACAGCTCTGGCAACTTCTCAACTGTCATCAAAAACATGGACTTGGATAACTGGGTTGAATACTGCCCGTGA

Fig. 82
PUTATIVE AMINO ACID SEQUENCE OF Penicillium chrysogenum Agd3  (Genbank No. Pc20g06090)

MIAAPVWALKVGCYYAFITCDTAPGVWPEKTPTVITYHPPVSTPSSTPTSSAGVSSTTVATSTHSFTSSLSSTPVTSSPS
TSTTSVTSTFVTFTSSGSISSDSVSESVIVTVPSGTSSVPTQSGTLSVSSSSSAIPSSLVSSSVVSSSAVSTAPVSTSAS
VTTPRMSSTAISISASPSATSLNHATVAADILVIARDAAAAGVASSGLNGYGIPFTTLLVPSAGVALPDLNGTAGGNFGG
IVVASEVSYEYGGDVGFQSALTTDQWNQLYAYQLEYGVRMVQYDVYPGPKFGTSALGGCCDDGIEQLVSFTDISDFPTSG
LKTGAGVSTSGLWHYPATISNTTSTKQIASFGPTTGFTTESAAGVINNFDGRQQMAFFIGFDTNWSATSSYLQHAWITWI
TRGLYAGYRRVNLNTQIDDMFLETEIYSPAGENFRIRAQDMINIASWTDEINAKMPAGSSYFVEVGHNGNGNIENSSDTS
DAGWDSCGSAIEYDSPPDTEPEWMKPLGTGTDLWPAAPTAYDWTNTCTAMDELLTWWTTESNLNKFGHVSHTFSHEEQNN
ATYSDVYKEISFNQAWLKAVGIDKATKFTSNGIIPPAITGLHNGDALRAWWENGITNCVGDNTRPALLNKENDMWPLFTT
IAANNFDGMQINPRWATRIYYNCDTPACTVAEWIATSAGAGTFQDLLAIEKAETMRHLFGLYHDGYMFHQANLRNIDVTP
ITINGVSEKYSIMQAWVEVQVQEFVRLAEWPIITLTHQEMSASFLARFNRDKCGYSLSYATSNQKITAVTVSATGNTCTE
PIPVTFPVGPTSTQGFATEQLGADPLTVWVKLTGSPVTFTLSTPIFL

Fig. 83
BASE SEQUENCE OF NUCLEIC ACID MOLECULE OF Penicillium chrysogenum agd3 (Genbank No. Pc20g06090)

ATGATTGCTGCCCCAGTCTGGGCTTTGAAGGTCGGTTGCTACTACGCCTTTATAACATGCGACACTGCCCCCGGCGTTTG
GCCTGAGAAGACGCCGACTGTCATCACCTATCACCCTCCAGTCTCGACTCCTTCTAGTACTCCTACTAGTTCTGCTGGAG
TGAGTTCCACCACGGTCGCTACTTCTACACACTCTTTCACTTCCTCTTTGTCCTCTACCCCTGTTACCAGTTCGCCTAGC
ACGAGCACTACTTCTGTAACATCAACCTTCGTTACTTTTACCTCGTCGGGTTCAATCTCGTCCGACTCTGTTTCAGAGTC
CGTAATCGTCACTGTCCCATCTGGTACCTCCAGCGTCCCTACCCAGAGTGGGACATTGTCTGTTTCATCCAGCTCATCCG
CTATTCCCAGCAGCCTGGTCTCTTCGTCAGTCGTTTCTTCTTCGGCTGTTTCGACTGCACCTGTTTCCACAAGTGCTTCT
GTGACTACTCCTAGAATGTCGTCCACAGCTATCTCAATCTCGGCTTCTCCCTCTGCCACCTCGCTCAACCACGCTACTGT
TGCAGCTGACATTCTTGTCATTGCTAGAGATGCTGCCGCTGCAGGTGTGGCCAGCTCTGGGCTCAATGGATACGGTATCC
CATTTACCACTCTGCTTGTTCCCTCTGCTGGTGTTGCTCTTCCCGACCTCAATGGCACCGCTGGAGGAAACTTTGGTGGT
ATTGTCGTTGCCTCTGAAGTCAGCTATGAGTATGGTGGTGACGTGGGCTTCCAGAGTGCCCTGACCACGGATCAGTGGAA
CCAGCTATATGCTTATCAGCTTGAATACGGTGTCCGCATGGTCCAATATGATGTCTACCCGGGTCCCAAGTTCGGTACAT
CTGCTCTCGGTGGATGTTGTGATGACGGCATCGAGCAGCTTGTCTCATTCACTGATATTAGCGATTTCCCCACATCTGGC
TTAAAGACTGGTGCAGGTGTCAGCACCAGTGGTCTGTGGCACTATCCCGCGACTATCAGTAACACCACCTCTACCAAGCA
AATCGCCTCGTTTGGCCCCACTACAGGGTTCACTACTGAGAGCGCTGCTGGTGTGATCAACAACTTCGATGGCCGTCAGC
AGATGGCCTTCTTCATTGGTTTCGACACTAATTGGAGTGCTACATCCAGCTACCTGCAGCACGCATGGATCACCTGGATC
ACCCGCGGTCTGTACGCCGGGTACCGCCGTGTCAACCTGAACACCCAGATTGATGACATGTTCCTCGAGACTGAAATTTA
CTCGCCCGCTGGTGAAAACTTCCGTATCCGCGCCCAGGATATGATCAATATTGCCAGTTGGACGGATGAGATCAACGCCA
AGATGCCCGCCGGCAGTTCTTACTTTGTCGAGGTCGGCCATAACGGTAATGGAAACATCGAGAACTCTTCTGATACATCG
GATGCTGGCTGGGATTCTTGCGGATCTGCTATTGAATATGACTCGCCTCCTGACACTGAGCCCGAATGGATGAAACCGCT
TGGTACTGGCACTGACCTGTGGCCCGCCGCCCCTACTGCTTATGACTGGACTAATACTTGCACTGCCATGGATGAACTCC
TGACCTGGTGGACCACCGAAAGCAACCTCAACAAGTTCGGTCATGTTTCCCACACCTTCTCACACGAGGAGCAGAATAAT
GCTACCTACAGCGATGTCTACAAGGAGATCAGTTTCAACCAGGCTTGGCTAAAAGCCGTCGGTATCGATAAGGCCACCAA
GTTCACTTCCAACGGTATCATTCCTCCTGCCATTACCGGTCTGCACAATGGCGATGCCCTTCGCGCCTGGTGGGAGAACG
GCATCACTAACTGTGTGGGCGACAACACCCGCCCTGCTCTTCTGAACAAGGAGAATGACATGTGGCCTCTCTTCACAACT
ATTGCCGCCAACAATTTCGACGGCATGCAGATCAACCCTCGCTGGGCCACTCGCATCTACTATAACTGCGACACTCCTGC
CTGTACCGTTGCAGAATGGATCGCCACCTCTGCTGGTGCCGGTACCTTCCAGGACCTCCTCGCCATTGAGAAGGCTGAGA
CCATGCGCCATCTGTTCGGCCTCTACCATGATGGTTATATGTTCCACCAGGCCAACCTGCGCAACATTGATGTTACCCCA
ATTACCATCAACGGTGTGTCTGAGAAGTACTCCATTATGCAAGCTTGGGTGGAGGTCCAGGTCCAGGAGTTCGTCCGCCT
GGCTGAATGGCCCATCATCACACTCACACACCAGGAGGTAGGATGAACCCCATCTAACATGTTACAACGCCTCATTCATT
CGCTAACTCGTCATAGATGTCCGCTTCCTTCCTTGCCCGTTTCAACCGTGACAAGTGCGGCTACTCTCTGAGCTACGCCA
CTAGCAACCAGAAGATCACCGCTGTCACTGTCTCTGCCACTGGCAATACCTGCACTGAACCCATTCCGGTGACCTTCCCA
GTTGGTCCTACCAGCACCCAGGGCTTCGCCACTGAGCAGCTAGGTGCTGACCCACTGACCGTCTGGGTTAAGCTCACTGG
ATCCCCTGTCACATTCACTCTCTCCACTCCCATTTTCCTTTAA

Fig. 84
PUTATIVE AMINO ACID SEQUENCE OF Penicillium chrysogenum Gtb3 (Genbank No. Pc20g06080)

MNGVESLPSRPHPLGWDAMKEHWWQFVFIGVLLFTVTTGSLSIIYSGVKSLIKYYKSRPLPDNVPSAVSKRLAKLANREL
NLIDRRPCKGKPVSFGVYLGSFENPPTASQERLLQEWDILVVDPFQTGVAKAISRHERSQVIGRVDFGKFLPPKASALTV
IEKIEELLAIGFNDTAFSGVLLANWEDVLRPTARRKLLETISSLGLAVYLESEPPHFLKDRKAVQSDAVAGLVIRNASIM
PQGEKRDYFQLAELQATIKAFVSESCMRDFVVMAWETVDDNVTVSNAIVRRSIQWCGFYSAITWIGPEAALRDADLNVTT
LEPLPAFGWLKEAEIMKAHDIWRANLNILPSPDTKAGWDILKPIFPAIDALLDSSEYDPKAPDSPTARLRDPPEWVAQVK
SQGSPLSISMSGMAYNSLGCFPLGSDSNPLAFAEIVQSQRRLKSLNLLHPVPTSKIQSIGLLLRQFYDSLDFSGDDEHLA
NTIKDLANWASDDLLHVNLCLDSGLRKSSDLRFWAVFDMEHDGIEIYVSKNAQGLAGTVLHTFLSAKGFPRHVCFEAEAT
FATWSQNVSHDTGLPRRLIQDIDALSPEERLLLLQHLSLTGSHSELSKVICTYIRKQLVDAPSFAQLKALNTVGYLEKST
SPEELIRSRINWYMDQGCNYPSLEVCLGLFNQADSVLFDVLRYRREDDLAAITSGLCALLQGGSVDAYVDMMALALFCAA
RRGAFDEIYAEVTDRNPLFNNHTDQAAAFAESFALGSRCEAYFDVAPSVFGKLLSDRFRAYYGDHQPPNWVNGAPQLATS
YAGAQIDVNPDEQPKTMPGYQRFTFLSVFAIPALIDIILLTMVGRGLYLSAAMSHDEQDSATMALMISLLLSGAIGTWIA
CGGPYYLISMAFAAANMFVLIRLIAGIAFTVAGGLIGFVAISGVRGPRAGIIFYLYLIALTIYFSTFASLASFSYPGSTF
LSGRKSIIMCIPILFLSPIITAWTGHDSAVYLTVIYIFIGVLLLSLRSVTSKWVTWYQSVRRTDDTEIRKWYISAHGKND
EKVFANMSDPAALKLAREALSKEVLAETTRGIFSKASKDKMVVELARDWESTNFLLDWYCRYADVPRPIPFSSGWNIQTK
VALDTLRNSQKGLHLHNAFVHWRQSSKEMGCGVLYFVIALLDKWAQLLSGDRMLAFLPAENDANRMAVGFALAYYLIGAV
LIDTKAQELHDALGSKPPLSVRSAKDIRLVQKQEVQLRRKVYWRVLFRFLLWHVWSLALATALIWTFQSMVEGMTIFFSY
VLAYTGLIWYQYTKIFTGPHALKPLIIGICIGLPVGIALRVSLPDNKYSQIIGLGAATWTVAILSMWNAKMGMPNKVDSP
VELGRTFHAFTTPWSDPEWSQQELQTFFESYSLLPSDSRFRLNPGVHPGVEIKSVMLSRREELRIEEAFPCSKNIVNTAI
TSWEKGDIVIELVSPGSLGPGIRALSCSTGNQLKLAIAVGGLLDERLDISANCQVIAETLLHAATELMMGVPHEYASLAG
SIVSGGVTHTMARQLREEANTTTVVRWAKKELLRQLCLGFEPDLHWDKLPTEVRDVLLKRCLGEQCSLSNSQREWLQQNL
CTFDTDDLNVHVARCNLGAATAVSVLDYAHWGTGETALPKEPETSKYISYIPRKLPMALSLVRSPASYIYHKLGSLVKFF
VVALVADPEFQREFNHVTQTLPTVVRVPIVFLLNMVWVYSKIVQNLGLSFFVFHGRKNVKQLWEETKGMTIHIKKNRVIV
QSLEGTFTTFRHHEIDGGFKVYHYSGEHNTEPKEVKSLKYVSTYSSEMLLLVKQEFKDGKVVNEYHYDYQAPTKKGFKLT
KSSNRIPLGRRCVSGANHLQSVQYNRKGLIESGSYMKDGNLIRFKYHYRKNPRFGDELLRAEFVLSHISCTVSWCAPPRR
HPEKVERWIPHSKVTEASFVQGADVYESRWLYDHKFHPTIFTTINGQKMQTPPMIEHDYLGVLAKPKYTSFVHDNPFVYC
DSLQSNILTRALGLTKKRFVVSTSQARSLMWKAWKDRVDFDAIIVRWMDDRILRRDKVLSPYWRSRDWGNLTSAKKYMDL
RADAIMASADLDDNVSSWTPLAVKLTDLLSFGSGGDSVVNTRSKNFGTDTDKTLHVMAADNGTWPNEGGGVSACRRDMIN
SLSTIKWHMICESANDFGVPKHQTEQNIQSLKIIPLWGMDFLTPTHGLFHNKLDAEVDNVTSASEFDIKMNFIPILTALV
KGARAVHLSKSDIHQATRALVNLNTYFQESRHWTQVWNSEMVKQSWRDLWLTQEMPNTIPSSQWFDTELPTLGSLDIALE
LWYRYLFIFSIPVPEKIPSTFQASHHSVSASYGVVCKIKRNCTLQIWDHAIAWRETNLCLSSALCKLSPFVRNALLGLMR
ITSVLTLHHADIILPCADFFNPGWEVEIGTCQGTIEHRNTFRRKIDPVVNGITDMQKFSPVKEIKSERPTVTMLSHVWYA
KDIKTALLAADIIINQWKFDEYHLDIYGAIDKAPTYSTECQEIIASKGLRGRVTLCGTADPMKVLENTWLFLNSSLSEGL
PLALGEAALTGAPVVCTDVGASLRVLSDPDDFSRFSAVVAPNDALALAKAQIGMLAMLGEWSKHSDDASPAPVLTSSPTP
EEVAAITRRMYEKSEHRRKLGMMTRKIVQKSFSGDRYLREHEQMLWIGKSAKMMASRAAGDPIEPADVAAAIETGVDEEI
IAIPRGVVHSWRSSAQSGISTIYSSASQIPGRGGLHRPASDISAMSMSMSNVSTDTESFGRLPVFAPRPTVLPNGGSPGN
MSPMWTSNHRLSALNAGPHSRPQSYSRSVSTAGREQLRGLQREDFLPYRNSDISVANRDDFLRAGGLDPSQAS

Fig. 85
BASE SEQUENCE OF NUCLEIC ACID MOLECULE OF Penicillium chrysogenum gtb3 (Genbank No. Pc20g06080)

```
ATGAATGGAGTAGAATCACTCCCATCCAGGCCACATCCTCTTGGTTGGGATGCCATGAAAGAACATTGGTGGCAATTTGT
ATGTTGACCCTGGTCCTCTTTACAACTTGACGTTTGGCACTCTCGTCCCAAACGCAGAGCACGAAGATTTGCTGACTATT
TTCCCTAGGTATTCATTGGAGTGTTGCTATTCACAGTCACCACTGGCTCTTTGTCAATCATATATTCTGGTGTAAAAAGT
CTTATCAAGTACTATAAGGTATGATATAGCGGTCACCGACAAGCTGTTCTCCTCTAGTCTGAATATTAATTCCAGTCTAT
TTTTAGTCGAGACCGCTGCCAGATAATGTACCCTCGGCTGTGTCCAAACGTCTGGCCAAGCTAGCCAACCGAGAGCTCAA
CTTGATTGACAGGCGTCCATGCAAGGGAAAGCCCGTGAGCTTCGGAGTCTATCTGGGAAGTTTCGAAAACCCACCCACTG
CCTCTCAAGAAAGACTTTTGCAAGAATGGGATATCTTGGTCGTGGATCCCTTCCAGACAGGTGTCGCCAAAGCTATTTCC
AGACACGAGCGCAGCCAAGTAATAGGACGTGTTGATTTTGGGAAATTCCTTCCCCCAAAGGCATCCGCTCTGACCGTGAT
CGAAAAGATCGAGGAATTGCTTGCAATTGGATTTAACGATACCGCTTTTTCCGGTGTTCTCCTCGCGAATTGGGAAGATG
TGCTCCGTCCTACCGCTCGAAGAAAGCTTCTCGAGACCATCAGCAGCCTCGGCCTGGCAGTATATCTCGAGTCTGAGCCT
CCTCATTTCTTGAAGGATCGAAAGGCCGTGCAGAGCGATGCCGTGGCGGGTTTGGTCATTCGAAACGCTAGCATCATGCC
TCAAGGCGAAAAGCGGGATTATTTCCAACTGGCCGAACTGCAAGCAACAATCAAGGCATTTGTTTCTGAGTCTTGCATGA
GAGACTTTGTTGTAATGGCCTGGGAAACCGTCGACGACAATGTCACTGTTTCCAATGCCATAGTCCGCAGATCTATTCAG
TGGTGCGGCTTTTACAGCGCAATTACCTGGATCGGCCCTGAGGCTGCTCTTCGCGATGCGGATCTTAATGTCACGACTCT
CGAACCTCTCCCCGCGTTTGGTTGGCTGAAGGAAGCAGAAATTATGAAGGCCCACGACATCTGGCGTGCCAACCTGAACA
TATTGCCTTCCCCGGATACCAAGGCTGGCTGGGACATTCTCAAGCCGATTTTCCCTGCGATCGATGCGCTACTGGATTCG
TCAGAATACGACCCCAAGGCACCCGATAGCCCAACTGCTCGACTGCGTGATCCTCCAGAATGGGTCGCACAGGTCAAGTC
ACAGGGCAGCCCTCTCTCTATCTCCATGTCAGGGATGGCATACAATTCGCTTGGTTGCTTCCCTCTCGGCTCTGACTCGA
ACCCACTGGCCTTTGCAGAGATTGTCCAATCTCAACGACGCCTTAAGTCTCTTAATCTTCTTCATCCCGTCCCGACATCC
AAAATACAAAGCATTGGACTCCTTCTACGTCAATTCTATGACTCTCTGGATTTCTCCGGAGATGACGAGCATTTGGCCAA
CACAATCAAGGATCTTGCGAATTGGGCATCCGACGATTTGTTGCATGTAAATCTTTGTCTCGACTCTGGTCTGCGCAAGA
GCTCTGATCTCCGCTTTTGGGCCGTTTTTGATATGGAACATGATGGTATTGAGATCTATGTATCCAAGAATGCACAAGGC
CTGGCTGGAACTGTTCTTCACACCTTCCTCTCAGCAAAGGGGTTTCCACGCCATGTTTGCTTCGAGGCAGAGGCAACCTT
CGCGACCTGGTCTCAGAATGTGTCCCACGATACTGGCTTACCTCGTCGACTGATTCAAGATATCGATGCTCTCAGCCCTG
AAGAACGTCTCCTTCTCTTGCAGCACCTCTCTCTGACTGGTTCACATAGCGAGCTATCCAAGGTCATCTGCACATACATT
CGCAAGCAACTGGTCGATGCCCCCTCTTTTGCTCAGTTGAAAGCGCTGAACACGGTTGGGTATCTTGAGAAGTCCACCTC
TCCTGAGGAACTGATCAGGTCTCGTATCAACTGGTATATGGATCAAGGATGCAACTACCCATCTCTCGAAGTCTGTCTTG
GTCTTTTCAATCAGGCCGACAGCGTACTGTTCGATGTTTTGAGGTATCGCCGCGAGGATGACCTTGCCGCCATTACTAGC
GGTCTCTGTGCGCTTCTTCAAGGCGGCTCTGTTGATGCATATGTGGACATGATGGCTCTTGCGCTTTTCTGCGCTGCAAG
ACGGGGAGCCTTCGATGAGATTTACGCAGAGGTTACGGATCGGAATCCCCTTTTTAACAACCATACCGATCAGGCTGCCG
CCTTCGCAGAGTCATTTGCCCTGGGATCTCGATGTGAGGCTTACTTCGATGTGGCTCCCAGTGTTTTCGGAAAGTTGCTA
TCCGACCGATTCAGAGCTTATTATGGAGACCATCAGCCGCCGAACTGGGTGAACGGAGCTCCGCAGCTTGCTACATCCTA
CGCCGGAGCTCAGATTGATGTCAACCCTGATGAACAGCCTAAGACTATGCCTGGATACCAGCGATTCACATTCTTGAGCG
TCTTCGCCATTCCAGCTCTGATTGATATTATCTTGCTTACCATGGTTGGCCGTGGGCTTTATCTCTCTGCTGCCATGTCT
CATGATGAACAGGACAGTGCAACAATGGCGCTGATGATCTCCCTGCTGCTTTCCGGTGCAATTGGTACCTGGATTGCATG
TGGCGGTCCTTACTACCTCATTTCGATGGCGTTTGCGGGCAGCGAACATGTTCGTTCTCATTCGTCTAATTGCAGGTATTG
CCTTCACTGTGGCCGGTGGCTTGATCGGCTTTGTTGCCATTTCAGGTGTTCGAGGCCCTCGCGCTGGTATCATCTTCTAC
CTCTACCTGATCGCTCTGACAATCTACTTCTCGACTTTCGCCTCGCTTGCAAGCTTCAGTTATCCCGGCTCGACCTTCTT
GTCAGGTCGTAAGTCAATCATTATGTGCATTCCGATCCTCTTCTTGTCGCCGATCATCACGGCCTGGACTGGCCACGACT
CGGCTGTCTATCTCACCGTTATCTATATCTTTATTGGTGTGCTCTTGCTCTCCCTTCGTTCGGTTACCTCCAAGTGGGTC
ACTTGGTACCAATCCGTGCGACGCACTGATGATACCGAGATCCGCAAGTGGTATATCTCTGCCCACGGAAAGAATGACGA
GAAAGTGTTTGCGAACATGAGTGATCCGGCTGCCCTCAAGCTGGCGAGAGAAGCCCTATCGAAGGAAGTCTTGGCTGAAA
CGACGCGGAGGTATTTTTTCAAAGGCATCTAAAGACAAAATGGTCGTTGAGCTTGCCCGGGACTGGGAGTCTACCAATTTC
CTTCTCGACTGGTACTGTCGCTATGCAGATGTTCCGAGGCCGATTCCGTTTAGTTCTGGTTGGAATATCCAAACCAAGGT
CGCACTTGACACCCTACGCAACTCGCAGAAAAGGTCTTCATCTGCACAATGCATTCGTTCACTGGCGTCAGTCAAGCAAGG
AGATGGGATGTGGTGTTCTCTACTTTGTGATTGCGCTTCTCGACAAATGGGCGCAACTGTTGAGTGGTGATCGCATGCTT
GCTTTTCTTCCTGCCGAGAATGATGCTAATCGAATGGCCGTTGGCTTTGCCCTTGCCTACTATTTGATCGGAGCGGTCCT
CATTGATACCAAAGCCCAGGAGCTCCATGATGCCCTTGGCAGCAAACCTCCTCTTTCCGTCAGATCTGCGAAAGACATTC
```

Fig. 86
GACTCGTACAGAAACAGGAGGTACAACTCCGGCGCAAGGTATAGTGGCGTGTCGTTTTCAGATTCCTCTTGTGGCATGTC
TGGAGCCTTGCGCTCGCTACTGCCCTCATTTGGACCTTCCAGTCTATGGTCGAAGGTATGACTATTTTCTTCTCCTACGT
TCTCGCCTACACAGGCTTGATCTGGTACCAATACACGAAGATCTTTACGGGTCCTCATGCACTGAAGCCTCTCATCATTG
GTATTTGTATCGGATTGCCAGTCGGTATTGCGCTCAGAGTCTCTCTGCCAGATAACAAGTACTCGCAGATCATTGGACTC
GGGGCTGCCACCTGGACCGTTGCCATCCTCTCGATGTGGAATGCCAAAATGGGTATGCCAAACAAAGTGGACTCACCGGT
GGAACTTGGCCGCACCTTCCATGCGTTTACGACGCCTTGGTCGGATCCTGAATGGTCCCAGCAAGAGCTTCAGACTTTCT
TCGAAAGCTATTCGCTGCTTCCTTCCGATTCCCGATTCAGGCTCAATCCTGGTGTCCATCCCGGCGTGGAAATCAAGAGT
GTCATGTTGTCCCGCAGAGAAGAACTTAGGATTGAAGAGGCGTTCCCTTGCTCCAAGAATATTGTCAACACTGCGATCAC
ATCCTGGGAGAAGGGCGACATTGTTATTGAGCTTGTCTCTCCTGGCTCTCTCGGTCCGGGCATTAGAGCTCTCAGCTGCA
GTACCGGAAACCAGCTAAAGTTGGCCATTGCCGTTGGAGGGCTCCTAGATGAGCGCTCTCGATATCAGCGCAAATTGTCAG
GTTATCGCTGAAACATTGCTTCATGCTGCCACAGAGCTTATGATGGGTGTTCCTCATGAATACGCATCGTTGGCAGGGTC
AATCGTCTCCGGTGGAGTAACTCACACAATGGCTCGACAGCTTCGCGAGGAGGCCAACACAACTACGGTCGTACGCTGGG
CTAAGAAGGAACTCCTTCGCCAGCTTTGTCTTGGTTTCGAGCCCGATCTCCATTGGGACAAGCTGCCAACCGAAGTTCGA
GATGTGCTGTTAAAGCGTTGTTTGGGTGAACAATGCAGCCTCTCCAATAGCCAGCGCGAATGGCTCCAGCAAAATCTTTG
CACATTCGATACCGATGACCTCAATGTCCATGTTGCCCGTTGCAACCTTGGAGCTGCCACTGCAGTTAGCGTCCTTGATT
ATGCTCACTGGGGAACTGGAGAAACTGCTCTTCCCAAAGAGCCCGAGACTTCGAAGTACATTTCCTACATACCTCGGAAG
CTCCCGATGGCATTGTCGCTAGTCCGATCACCAGCTAGCTACATTTACCACAAGCTGGGATCATTGGTCAAGTTCTTCGT
GGTGGCTTTGGTCGCAGATCCGGAATTCCAGAGGGAGTTCAATCACGTCACTCAGACCCTTCCGACAGTTGTCCGTGTGC
CAATCGTATTCTTATTGAATATGGTCTGGGTATATTCCAAGATCGTTCAAAATTTGGGCTTGTCATTCTTTGTCTTCCAT
GGCCGTAAAAACGTCAAACAGCTGTGGGAAGAGACCAAGGGCATGACAATCCATATCAAGAAGAACCGGGTCATTGTCCA
GAGTCTGGAGGGCACCTTTACAACATTCAGACACCACGAGATTGATGGTGGTTTCAAGGTCTACCACTACTCTGGTGAGC
ATAATACCGAGCCCAAGGAAGTCAAGTCCTTGAAGTACGTCAGCACTTATTCGAGTGAGATGTTGCTTCTGGTCAAGCAG
GAGTTCAAGGACGGCAAAGTGGTCAACGAATACCACTACGACTACCAAGCCCCGACTAAGAAGGGTTTCAAACTTACCAA
ATCATCAAACCGTATTCCACTGGGACGACGCTGCGTGTCAGGGGCAAACCATCTGCAAAGCGTGCAGTACAACCGCAAGG
GTCTTATCGAATCAGGTTCCTACATGAAGGATGGCAACCTTATCCGTTTCAAGTACCACTATCGCAAGAACCCCCGTTTC
GGCGATGAGTTGCTGCGAGCCGAGTTCGTCTTATCCCACATAAGCTGCACTGTGTCTTGGTGTGCGCCTCCGCGACGCCA
TCCCGAGAAGGTTGAGCGCTGGATTCCTCACTCCAAGGTCACCGAAGCCAGCTTTGTCCAAGGCGCCGACGTCTACGAAA
GTCGTTGGCTGTACGATCACAAGTTCCATCCCACCATCTTCACCACCATCAATGGGCAGAAGATGCAGACTCCGCCCATG
ATTGAACACGATTATCTGGGTGTACTGGCCAAGCCGAAGTATACCGACTTTGTCCATGATAACCCCTTTGTCTACTGCGA
CAGTCTCCAGTCAAACATTCTTACCCAGGCACTGGGCCTTACGAAGAAGCGCTTTGTTGTGTCAACTTCCCAGGCTCGCT
CCTTGATGTGGAAGGCGTGGAAGGATCGTGTTGACTTCGATGCAATTATCGTTCGCTGGATGGACGACCGTATTCTGCGC
CGAGATAAGGTTCTTTCCCCTTACTGGCGCAGCCGTGACTGGGGCAATCTTACATCTGCAAAGAAGTATATGGATCTCCG
CGCTGATGCGATCATGGCCAGTGCAGATCTGGACGACAACGTTTCCAGCTGGACCCCGCTCGCTGTGAAGCTCACCGATC
TGCTCAGCTTTGGTTCTGGTGGTGATTCCGTTGTTAACACCCGCTCCAAAAACTTTGGCACTGATACCGACAAGACACTT
CATGTTATGGCGGCAGACAACGGTACCTGGCCTAATGAAGGTGGTGGTGTCTCTGCCTGTCGACGAGATATGATCAACTC
CCTGAGCACCATCAAATGGCACATGATTTGCGAGTCAGCAAACGATTTTGGTGTTCCAAAGCATCAAACCGAACAGAACA
TCCAGTCTCTCAAGATCATCCCGCTTTGGGGTATGGACTTCCTCACTCCAACTCACGGTTTGTTTCATAACAAGCTAGAT
GCCGAGGTGGACAACGTTACATCGGCGAGCGAGTTCGACATCAAGATGAACTTCATTCCGATACTGACAGCTTTGGTTAA
GGGTGCCCGTGCAGTACATCTCTCCAAGTCTGATATCCACCAGGCGACTCGGCGCGCTTGTGAACCTGAACACATACTTCC
AGGAGTCCCGTCATTGGACTCAGGTGTGGAACAGTGAAATGGTGAAGCAGAGCTGGCGAGATTTGTGGCTGACCCAGGAG
ATGCCAAACACCATCCCGTCATCCCAGTGGTTCGACACTGAGCTTCCTACTTTGGGTTCTCTCGACATCGCCCTAGAGCT
CTGGTACCGCTATCTCTTCATCTTCTCAATCCCGGTTCCTGAAAAAGATTCCTTCAACCTTCCAAGCCTCACATGACAGCG
TCAGTGCCTCTTACGGTGTTGTATGCAAGATCAAGCGCAACTGTACCTTGCAGATTTGGGACCACGCCATCGCTTGGCGT
GAAACCAATCTCTGTCTGTCGTCTGCCCTGTGCAAGCCTCTCGCCATTTGTTCGAAACGCACTCCTTGGATTGATGCGAAT
AACCTCCGTCTTGACCCTTCACCACGCAGACATCATCCTTCCCTGTGCAGACTTCTTCAACCCCGGTTGGGAGGTCGAGA
TTGGTACCTGCCAGGGCACGATTGAGCACCGAAACACTTTCCGCCGAAAAGATCGATCCTGTCGTCAACGGTATCACCGAC
ATGCAGAAGTTTTCTCCAGTCAAGGAAATCAAATCCGAGCGCCCGGACTGTGACCATGTTATCCCACGTTTGGTATGCCAA
GGACATCAAAACTGCCCTTCTCGCTGGGGATATCATCATCAACCAGTGGAAGTTCGATGAGTACCATCTGGACATCTATG
GTGCCATTGATAAAGGCCCCAACTTACTCTACCGAGTGTCAAGAGATCATCGCATCAAAGGGTCTTCGTGGCAGAGTCACG
CTCTGTGGAACTGCCGACCCCATGAAGGTCCTGGAGAACACATGGCTTTTCCTAAACTCATCTCTGTCTGAAGGTCTCCC

Fig. 87
TCTCGCCCTAGGAGAGGCTGCTCTGACCGGAGCCCCCGTCGTCTGCACGGACGTCGGTGCTTCCCTCCGAGTCCTCAGCG
ACCCAGATGACTTCTCCCGCTTCAGTGCTGTCGTGGCACCGAATGACGCCCTCGCCCTAGCAAAGGCCCAAATTGGCATG
CTTGCCATGCTCGGCGAATGGAGCAAACACAGCGACGACGCATCGCCCGCGCCAGTCCTGACCTCCTCCCCCACACCCGA
GGAAGTAGCAGCCATAACCCGCCGCATGTACGAGAAGAGCGAGCACCGCCGCAAACTCGGCATGATGACCCGCAAAATTG
TCCAGAAGTCCTTCAGCGGTGACCGGTACCTCCGCGAGCACGAGCAGATGTTGTGGATTGGCAAGTCCGCCAAGATGATG
GCCAGCCGCGCAGCTGGCGACCCAATCGAGCCTGCCGACGTGGCAGCCGCCATCGAGACTGGCGTCGATGAAGAGATCAT
CGCCATCCCGCGCGGGCGTGGTACACTCCTGGGCGCTCATCTGCCCAGTCCGGTATCTCGACAATCTACAGTTCTGCGTCCC
AGATTCCTGGTCGCGGCGGCCTCCACCGTCCCGCATCTGATATTTCAGCTATGAGCATGAGCATGAGCAATGTCTCTACG
GATACCGAGTCCTTCGGTCGTCTGCCGGTCTTTGCGCCAAGGCCTACCGTGTTGCCCAATGGCGGCTCCCCGGGGAATAT
GTCACCCATGTGGACCTCCAACCATCGGTTGTCGGCGCTAAATGCCGGTCCTCACTCTCGCCCTCAGTCCTACTCGCGCT
CCGTCTCAACTGCTGGTCGGGAACAGCTGCGTGGCTTGCAACGTGAAGACTTCCTTCCGTATCGAAACTCGGATATTAGT
GTCGCTAACAGAGACGACTTCCTTCGGGCTGGCGGACTTGATCCTAGTCAGGCGTCTTGA

Fig. 91
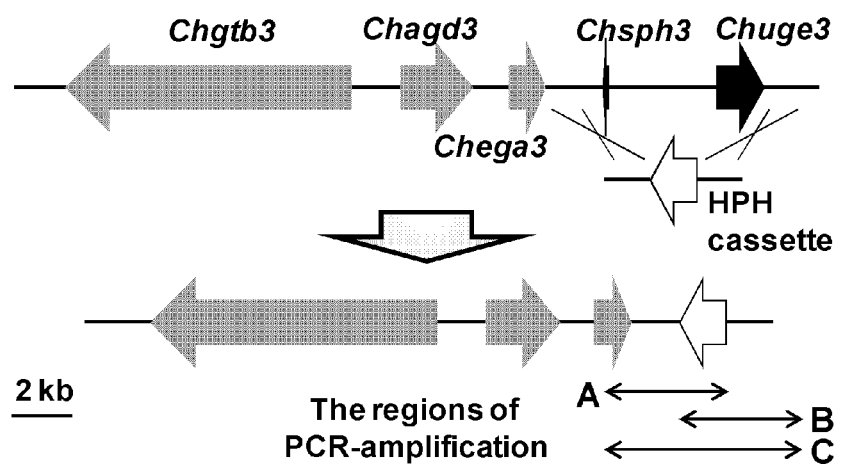
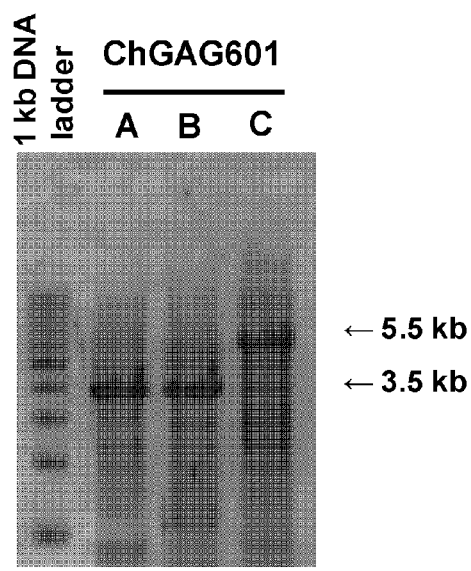

Fig. 92
(A) 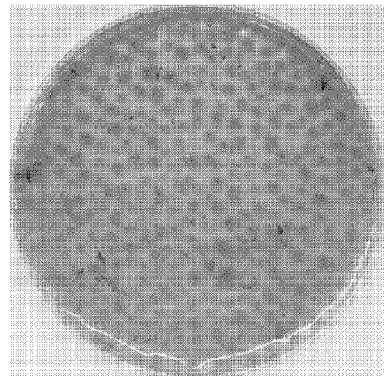 (B) 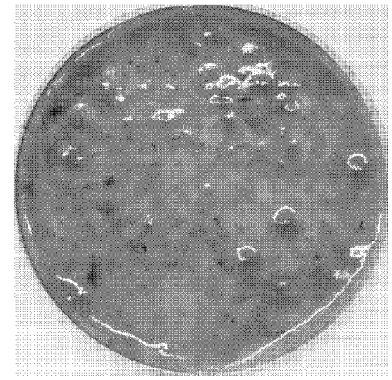
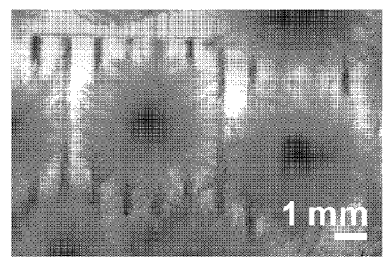 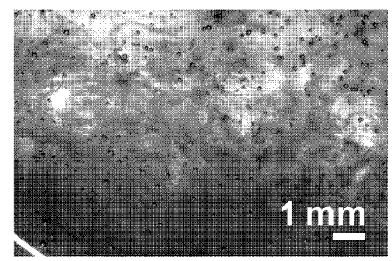
C. heterostrophus
Wild-type
C. heterostrophus
GAG601

Fig. 93
(A)
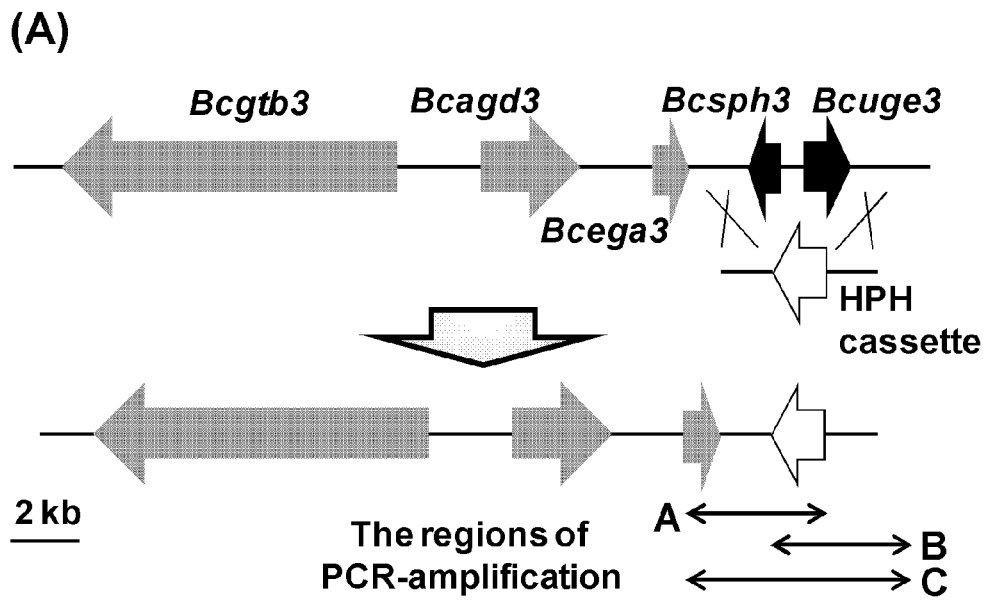
(B)
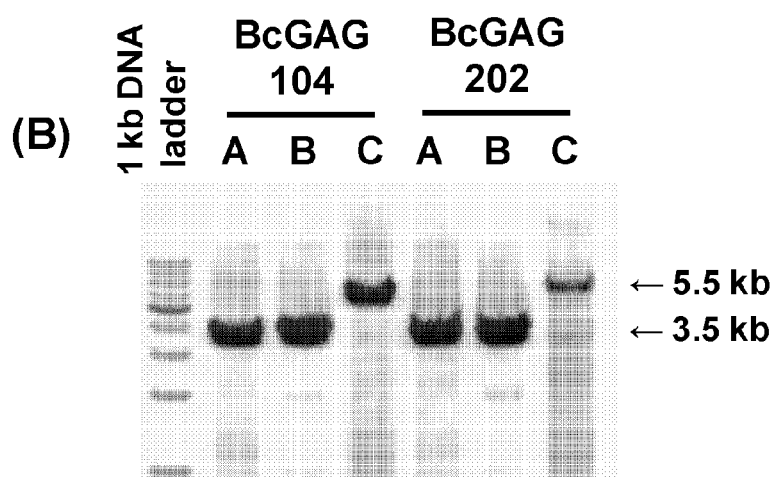

Fig. 94
(A) 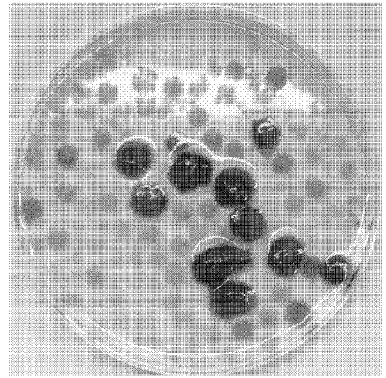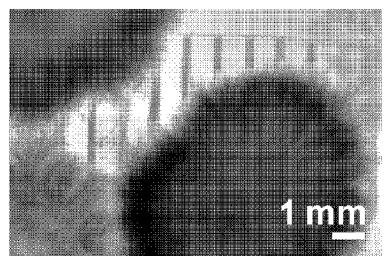
*B. fuckeliana*
Wild-type
(B) 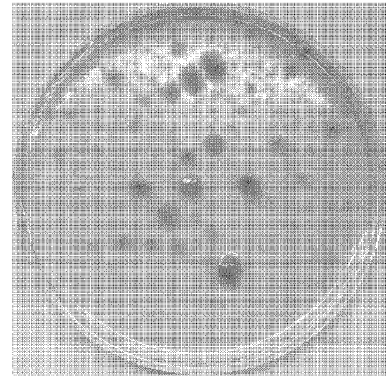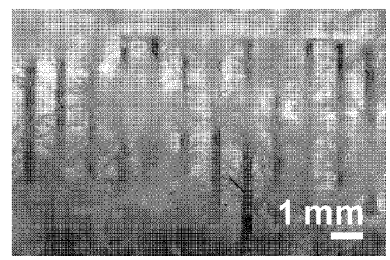
*B. fuckeliana*
GAGΔ104

Fig. 95
PUTATIVE AMINO ACID SEQUENCE OF Bipolaris maydis uge3 (Gene ID: COCHEDRAFT_1185586)
MSACSSQFSVSPSATPEMVSTPATQSSVLFDDDVAADPLDIEGVGSSFIMVVGGLGYIGSHTTLELLKEGYNVLVIDDLS
NSYQNVLDRVKFLAEEFCREQGRRLPALHFQQLDYRSPQMKIVLANYSSYSVSSKPVSALARRFPYTNLQRTDSGIEMET
DDRQEPVIERRSRITGVIHFAAYKSVEESIRTPLRYYSNNVCGLVDFLGLIEQFGIKNFVFSSSATVYGEGANCGVPLRE
ELCVHHPETFVDGEGRERQVLPGVLGLTSPYGRSKFMCESILADLAVADPTWSITALRYFNPVGCHESGILGEDPRQKPS
NLIPVIATVMTGARPVLDIFGTDWNTPDGTAVRDFIHVVDLARGHIAALAASAAGRTKAPFRTYNLGTGNGHTVREVLHS
LEEVSQRKIPAREVGRRAGDVGFCVAEVQRAETELQWKAERNLRDCAGDVWNFTKGRCPDVQEVSDAQC BASE SEQUENCE OF NUCLEIC ACID MOLECULE OF Bipolaris maydis uge3 (Gene ID: COCHEDRAFT_1185586)
ATGTCTGCATGCTCCTCACAGTTCTCGGTGTCGCCATCCGCGACACCAGAGATGGTCAGCACACCAGCGACACAAAGCTC
TGTGCTTTTCGACGACGACGTAGCAGCGGATCCATTGGACATTGAGGGCGTCGGCTCTTCCTTCATCATGGTTGTTGGCG
GATTGGGCTACATTGGCTCCCACACAACACTGGAGCTGCTCAAAGAAGGATACAATGTCCTTGTAATCGACGACCTCAGC
AACTCTTACCAAAATGTCCTGGACAGGGTCAAATTCCTTGCCGAGGAGTTCTGCAGGGAACAAGGACGACGACTGCCTGC
ACTTCACTTTCAGCAATTGGATTATCGAAGTCCGCAGATGAAGATCGTACTGGCCAATTACTCTTCGTATTCCGTCAGCA
GCAAACCAGTATCAGCATTAGCCCGTCGCTTCCCGTATACGAATCTGCAGCGAACAGATTCCGGCATCGAAATGGAGACG
GATGATCGCCAGGAGCCGGTGATCGAGCGTCGATCCCGGATAACGGGTGTTATCCACTTTGCCGCCTACAAATCTGTCGA
AGAAAGCATTCGCACGCCACTGAGGTACTACAGCAACAACGTTTGCGGTCTAGTTGATTTCCTGGGCTTGATCGAGCAAT
TCGGCATCAAGAACTTTGTCTTCTCGTCCTCGGCTACAGTATATGGTGAGGGTGCCAATTGTGGTGTGCCTCTACGCGAG
GAGCTATGCGTGCATCATCCAGAGACTTTTGTCGACGGTGAGGGACGCGAGCGTCAGGTGTTACCGGGTGTCTTGGGTCT
CACTTCGCCTTACGGACGTTCAAAATTCATGTGCGAATCCATCCTTGCAGATCTTGCTGTGGCGGATCCGACATGGTCCA
TCACTGCTCTGAGATACTTCAACCCAGTAAGCCCTCATTCAAGTGACTTTTCAAACGAGAAATGCTAACGGAACAAGGTC
GGCTGCCATGAATCCGGAATACTAGGTGAAGATCCACGACAGAAACCAAGCAACCTCATCCCAGTCATTGCCACAGTCAT
GACGGGAGCCAGGCCGGTGCTGGATATTTTCGGTACCGACTGGAACACTCCTGATGGAACCGCTGTGCGTGACTTCATCC
ATGTGGTCGACTTGGCTCGTGGTCATATCGCGGCTTTGGCTGCTTCAGCAGCTGGTCGCACAAAGGCTCCATTCCGAACC
TACAACCTGGGTAAGCTGCATTTTCGCCTACAGCCCGCCCCTCTAGATGTGGTTGCTAACTCTTTCTAGGCACTGGCAAC
GGACACACGGTTCGTGAAGTGCTTCACAGCCTGGAGGAGGTGTCTCAACGGAAGATCCCAGCACGGGAAGTCGGACGAAG
GGCGGGAGATGTTGGTTTTTGTGTGGCTGAAGTGCAGCGAGCAGAGACTGAGCTGCAGTGGAAGGCTGAGAGGAATCTCA
GGGATTGCGCTGGAGATGTGTGGAACTTTACCAAGGGTCGGTGTCCCGATGTGCAAGAAGTTAGTGACGCGCAGTGC PUTATIVE AMINO ACID SEQUENCE OF Bipolaris maydis sph3 (Gene ID: COCHEDRAFT_1023805)
MEAFHTPVLQALLASHHPLTSFPKASMGGRHVLNDWTSVYLSITKVCTMPLIP BASE SEQUENCE OF NUCLEIC ACID MOLECULE OF Bipolaris maydis sph3 (Gene ID: COCHEDRAFT_1023805)
ATGGAAGCTTTTCACACACCAGTGCTGCAGGCCTTGCTCGCTAGCCATCACCCCCTCACTTCGTTTCCCAAAGCGAGCAT
GGGTGGGAGGCATGTGCTGAACGATTGGACGAGCGTCTACTTGTCCATAACCAAGGTTTGCACAATGCCATTAATCCCCT
AA

Fig. 96

PUTATIVE AMINO ACID SEQUENCE OF Bipolaris maydis ega3 (Gene ID: COCHEDRAFT_1023806)

MDVKPTATTRSRRRKILCIVLPLVIVIVLALALGLGLGLGLNSGGDDDDNNNNGGSTPLPSPNNTLTWTPSVASTWQIIL
NHPPDVSSNNALTPNVSVYDIDLFDTPKSTIDTLHAQGIRVLCYFSAGSYEDWRTDAKDFKDTDLGKPLDGWAGERWIDL
KSDNVRAIMKTRIQLAKEKGCDGVDPDNVDGYQNDNGLGLTPADSIAFMQYLSNITAPLNLALGLKNAGDIVTTVLPVVH
FSVNEECVKYSECAEFAPFIDAGKPVFHIEYPDGAGAAQGLRANVLTDYCAKSGKGAGSDRFSTVLKKIELDGWVEYCDG
SVDVTNVSEAVGGGRNNSSS

BASE SEQUENCE OF NUCLEIC ACID MOLECULE OF Bipolaris maydis ega3 (Gene ID: COCHEDRAFT_1023806)

ATGGACGTCAAACCCACAGCGACAACGCGGTCGCGCCGCCGCAAGATCCTCTGCATCGTGCTCCCCCTCGTCATTGTCAT
TGTCCTCGCCCTCGCCCTCGGTCTAGGACTAGGACTAGGCCTCAACTCTGGCGGCGACGACGACGATAATAACAACAACG
GTGGCAGCACGCCTCTCCCCTCCCCAAACAATACCCTTACCTGGACCCCCTCGGTCGCCTCAACCTGGCAAATCATCCTC
AACCACCCACCAGACGTCTCCTCCAACAACGCCCTCACCCCCAACGTCAGCGTCTATGACATCGACCTCTTCGACACGCC
CAAATCCACAATCGACACGCTGCACGCTCAGGGAATCAGAGTGCTGTGCTACTTCAGCGCTGGCAGTTACGAGGACTGGC
GCACCGACGCCAAGGACTTCAAAGATACCGATCTAGGCAAGCCCCTTGATGGGTGGGCCGGTGAAAGATGGATTGACCTC
AAGAGCGACAATGTGCGGGCTATCATGAAGACGAGGATACAGTTGGCCAAGGAAAAAGGGTGTGACGGGGTAGATCCCGA
TAACGTCGATGGTTATGTGAGTTTTGTTTTTTTTATTCTCTCTTTTCTCTACCTCACAACCACCACTTCTTTACCATGTT
ACCAAGCCACACAAAAAAAAAGTTGGAAAGGGTGCTACAAGGGGGGGGGGGGGGAAACGAGTATGACTACAAAAATTGCT
AACGGAGAAATTTAAAAAAAAGCAAAACGACAACGGCCTCGGTCTCACCCCCGCCGACTCCATCGCCTTCATGCAATACC
TATCCAACATCACGGCGCCGCTGAACCTCGCACTCGGCCTCAAGAACGCCGGCGACATCGTCACCACGGTACTCCCCGTT
GTGCACTTCTCCGTCAACGAAGAGTGCGTCAAATACAGCGAGTGCGCCGAATTCGCGCCCTTCATCGATGCGGGGAAACC
CGTATTCCACATCGAGTATCCGGATGGCGCGGGTGCTGCGCAGGGATTGCGCGCAAACGTGCTGACCGACTACTGTGCAA
AGAGTGGCAAAGGCGCGGGCAGCGACAGGTTTAGCACCGTCCTAAAGAAGATCGAGCTCGATGGCTGGGTCGAGTATTGC
GATGGCAGTGTCGATGTTACTAATGTCAGTGAGGCCGTGGGTGGCGGCCGGAATAATTCTTCAAGCTGA

PUTATIVE AMINO ACID SEQUENCE OF Bipolaris maydis agd3 (Gene ID: COCHEDRAFT_1146217)

MSSYSRSLLRACLVSSLSFVLQPVSAFVGSATVSSTVLVIARDATSALNSASLGLQGYGIPYETLLVPQAGIANLPLLNA
SATNGNYGGIVVVGEVSYNYNDSYQSALTTAQWNQLYAYQTNFGVRMVRLDVFPTTEFGVVSTGGSLDDQPVTFTNTSAF
PSANLKTGVPISIASIYHTPANITNSSIAWEFASFSNAGTAAVINQIGARQQMAWFLPFALDWAPSSNILQHAWITWITR
GLFLGFRRIYLNTQVDDMFLETSLYRPEGQDFRVTPQDLTAHVTWQAALNARLPAGSEFFIEIGHNGNGDIEASAYTDLG
QTRCSPARAIEYADQPDGSPEYTKPIGTGVNIWPTTPTSYTWSLQCAQIDPLENWFAVTSNRDSFAHISHTFSHMDLTNA
TYADTSKEISFNRAWLKQVGLDAAQRWSTKGLIPPAITGLFNGDAIKAWMDNGIANVVGDNTRPRLRNNQSSFWPLATTT
SFNGYAGLNIMPRWATLIYYNCDLPACTTQEWIDTSAGAGTFDDLLDNARDTAIRNLFGLHWDPYMFHQANMRVADVPTT
TINGKTGQFSLLMSWLEVVTSEMTRLTTWPMKTLKHDDMAQQFLNRQTRDLCRPSMTWKTSANGASIESVSVFTAGGNTC
GTTIPITVPGSVADSTGATREQLGSDPLTLWVSMSGASRTYRLSSALPL

Fig. 97
BASE SEQUENCE OF NUCLEIC ACID MOLECULE OF Bipolaris maydis agd3 (Gene ID: COCHEDRAFT_1146217)

ATGTCGTCCTATTCTCGCTCGTTATTGCGGGCATGCTTAGTCTCCTCTCTTTCTTTCGTGCTGCAACCAGTGTCAGCGTT
TGTGGGAAGCGCAACGGTCTCAAGCACCGTTTTGGTCATCGCTCGCGATGCAACTTCCGCGCTTAACAGCGCCTCACTTG
GTCTTCAAGGCTATGGCATACCCTATGAGACCCTACTTGTCCCCCAGGCTGGTATCGCCAATCTTCCCCTTCTCAATGCC
TCTGCAACAAATGGCAACTACGGTGGTATCGTTGTCGTGGGCGAAGTCAGCTACAACTACAACGACTCGTACCAAAGCGC
ACTTACAACCGCTCAATGGAACCAGTTGTACGCTTATCAGACCAACTTTGGTGTGAGGATGGTCCGCTTGGACGTCTTTC
CTACCACTGAATTTGGTGTTGTTAGCACTGGTGGCAGCTTGGACGATCAACCAGTCACCTTTACCAACACAAGTGCCTTC
CCTTCAGCCAATCTCAAGACGTAAGTGCAAAACGACCCCTTTACCCCAATTGCAACAATTTGCAACGATGCCTGCTCAGC
TTCCACAAGCGGCGCTGGTGGCAAACGTTGATAGCCAGAAACACGAGGTACACACAGGACTAATCATGATGACAGGGGTG
TGCCGATAAGCATTGCTAGCATCTACCATACTCCGGCCAACATCACAAACTCTTCAATTGCATGGGAATTTGCTAGTTTT
TCCAATGCCGGTACTGCTGCAGTCATCAACCAGATTGGCGCACGCCAGCAGATGGCATGGTTTCTTCCATTTGCGCTAGA
TTGGGCGCCATCCAGCAACATTCTGCAACACGCGTGGATCACTTGGATCACCAGGGGCCTCTTCCTTGGTTTCAGGAGAA
TCTACCTCAACACGCAAGTTGACGACATGTTCCTGGAGACGAGCTTGTACCGTCCAGAAGGCCAAGACTTCCGCGTCACG
CCACAGGATCTCACGGCCCACGTGACATGGCAGGCTGCGCTCAACGCAAGGCTGCCCGCGGGATCCGAGTTCTTCATTGA
GATTGGCCACAACGGTAACGGTGACATTGAAGCATCTGCATACACGGACCTAGGCCAGACACGCTGCAGCCCTGCCCGGG
CTATTGAGTACGCTGATCAGCCTGACGGCAGCCCGGAATACACCAAGCCCATTGGTACCGGCGTGAACATTTGGCCTACG
ACACCCACTTCATACACCTGGAGTCTTCAGTGTGCCCAGATTGATCCACTTGAGAACTGGTTTGCAGTGACATCGAACCG
CGACTCTTTTGCTCATATTTCCCACACATTGTACGTGTACAATTGCTACTAAGACCCTGGCCACTGCTGACAAGACGCTA
GCTCACACATGGACTTGACCAATGCCACCTATGCGGACACATCAAAAGAAATTTCCTTCAACAGGGCCTGGCTGAAGCAA
GTCGGACTCGACGCTGCTCAGCGATGGAGTACCAAGGGTCTCATTCCACCTGCCATCACTGGTCTGTTCAACGGCGACGC
CATCAAGGCATGGATGGACAATGGTATTGCCAATGTTGTTGGCGACAACACCCGCCCACGTCTCCGCAACAACCAGAGCT
CGTTCTGGCCATTGGCCACGACGACGTCGTTCAATGGGTACGCTGGGCTGAACATCATGCCACGTTGGGCTACTCTGATT
TACTACAACTGCGATCTCCCTGCCTGCACTACGCAGGAATGGATTGATACGTCTGCTGGCGCTGGTACATTCGACGATCT
ATTGGACAATGCCCGGGATACTGCTATACGCAATCTTTTTGGGCTGCACTGGGATCCGTGAGTTCTCCGCTCGTGTCCGC
TTGGAGAAAGTTTACTGAGACATCACGCAGGTACATGTTCCACCAGGCTAACATGCGGGTTGCTGACGTGCCAACGACGA
CTATTAATGGCAAGACTGGCCAATTCTCGCTACTCATGTCGTGGCTCGAGGTTGTGACCAGTGAGATGACACGCTTGTAC
GTCAATCATGGCCGCATTCGATTAAGCAATGCTGACACACCTCTCTAGGACGACCTGGCCCATGAAGACGCTTAAGCATG
ACGACATGGCCCAGCAATTCCTGAACCGGCAGACGCGCGATCTGTGCAGGCCCAGCATGACCTGGAAGACATCGGCCAAT
GGCGCAAGCATCGAGTCTGTGAGCGTGTTCACGGCAGGCGGCAACACGTGCGGTACAACTATTCCAATCACGGTGCCAGG
GTCGGTAGCAGACTCAACTGGCGCAACCAGGGAGCAGCTAGGCAGTGATCCCTTGACGCTGTGGGTGTCTATGAGTGGTG
CGAGCAGGACGTACAGGCTCTCTTCGGCATTGCCTCTCTAG

Fig. 98
PUTATIVE AMINO ACID SEQUENCE OF Bipolaris maydis gtb3     (Gene ID: COCHEDRAFT_1146218)

```
MAKPDVLGIEAFKDGTRIRDWWDWTLIAIIAASGFVGLVALVWSTYRSLRKVLKEDEDETALPRSVQERIHLLSNSSSVV
RVTHALPAKPSSFGVYLGALQTPVTPEEAQVLSQWEALVLDYRQTGILEAVSNDAVPMGPYIIARLDLSHVITSAVKGTE
LDLSQAIYLLSCTIEQNLRRPDQKRYFTGVLIAEWRNRVPIALLHGLTKLLSAHGLDSYLEIGAPDFLDGVKKLDLSLFA
GVVVRNGTIKSNGERRDFFDMDKMKTTTRSFVSQACQRSFVTMMWDTVDDNAELSHAVLRRAHMWCSYHGAVPYFPRQCA
LTNIYDVSSCEEPLAAFQWLKTRKVMDVHDKYRTARTISPGFSSLFDDYVPLQEIFPLLADTLAGLDGDMPNDDDSSSTL
TLTVEYPEVDENGVLVPQEPSSPTSLGLDWTMAVEKHTDNPLSCSFDGSPYSSLGCFPIGIDASKADFDRVLKSQRHLRD
LKLLSRLPVEQFSATAETLSRYASSSSHFLNLVPTMREAILALVEALDHAVEDGADPYRFQAYSALDSGFHTPNGASFWG
VWELDPRTKAIIIYVSKSVQDVKGVLLHTYLSMMGFSRYQCFLAEYGLSEFAAGSFSPERLPDRLVQDLDLLSSSELLNY
LQHIRYSEWEEECSLLPAIRERCKELLIDVPTYHQFKQLSNVDYIGEKVTDEELVNAKLKWYRLSRVPTLDEAQALQLFR
HINEVFTSILWWRDHQKLDTITSAITDITSRGTLDSAADFVLFCIFCAARKAGFEEVYIEVSDRNPLFNQYSDQSAAFAE
LFALGSRCEAYFDIKPSDMGILLSEKHRAYYNQEEHQPPMWIFNAPSFASAYAAAQTDIDPEQKASVMPAYRRFTFLSVF
AIPALVDIVLLSTTGHGLYLSVRMTEDDRYYATLALMCSLLLSGAIGTWISIGGTYYLISMAFSAANMFVLTRLVGGLAF
TLAGCLLGFIVISAVSGPGHGAVFFFYLFGLTTYLTVLAVLSTYQIPGSSFLNGRKIIIMVIPTLVISPILTIFIGMKGH
DIYLYLGVLYIFVTLLILGTRRVATQWVTWYHNIKTLNDSDIKNWYMKLHSEREQEATALKNRGQSKGPAISTVAGGSLV
ASSEGSFSEPDIFQGMSEPAILALCRNALHEAVLKEHGRHFWQKSTKDSFVKQLAGCWDSTLFLLDWYARITDTKRPIPY
SSTWNLETQVALESMQQSQKGIRLHNSFIHWRTAGDEIYCGILYFLVALMDRWLDILNGGQIVDMPGADSPVQLSAGLGL
AYDFAGEMDTALRLSVGFGLAYYLIGAVLLDYKAQHLHTLSEQMAPISIENTQQIKQAKANDLKFRRHLYFNTLCRFIGV
HVWALAFCTALIWIFNSSSIGLTLFLSYVGAYTGLLLYQYNKIFSGPHALMPLLAAVVVGLIVGNVLLAVFPGFLYDRII
ALAASTWTAALLSFRTAKLGMPEALDFSKWVSESFSSAKRSKKAANTVNAQPDDGTESPMSDKFHAYNSGNSDSEYSQSE
LRAYCNMIRAAAKENRYRVNPVGQPGDQIVALLLSCTHDSLSRQALQAFPAMPSTIQRIVSAWRNGQIDVFIVPLQAVVN
FNNDLRAISHFADGHLTLYITSDAKGPGFGQTNVSSNCTAIAETLLHACMETFLETPHSQAEIAESILACRENDGEQYAI
SECNRRSMPALVAGQDALSYGKACRRELLRNLCLGFDCETQWDSLPLDIRRLFFRRCLGIRAPYTNKELSWIHENIRTEE
SCAILSVIARYDLGAYLAVVKYSYFRNRGDQSLSNKEYRQVTADIQTAYHPVLNRSAVSMFSLFTEYIRLPVAYVYHCAG
TWVKFFVLACMADPEYQRELNGALLHKPWIVAKPTTFLLTGLWIYSRRAMSIALPFFLYHRRKDIAGLAGTVKGSLIIQR
KNRLVIQSAGETETAFVHPDKDGGFKLIFYSGALKTEPTWGGQIRVSHYDKEMRIKLRQEWKNGSVTNEFTYEYETNQTQS
KIKISKVRSTKIPLSRICGKGENDGAKVLYNHKGHIESGSYISHNNLVRFKYHYRKNAKYDDELLRAEFVLPHMSANVSW
CAPPVRHAEKTERWIPTPRVHEATFVQGADVYECTWFYDHKFHPTITTKLNGIMVDTPDMIRHDWLGVLKKPTRCTFADE
NPLLAFKTPTSNFLGRLFRRNIKQQEISTSRARSHLWKAWKKRNDLDGVVIRWVDEELIRKEALLRPYWRRRDRGSLVKA
EDYLALHADAIMASSDLTSDISAWTPLAIRMSDLFSFGQGGDAVVFTRTKALQRDTDNSLHVIAVDTGTWPNEGGGVSAC
RRDLINNLRTIKWHMVVESANDFGLPKHQTEENVESLKIIPLWGLDFMHPNHGMFTNKLDSEVDHLVKAATLTDIETNFI
PTLTALVRGARATTMTSADVKQATRALVNLNTYFQDSRHWKEVWTSDIVKDSWRKLWLTDDMPNAQPAKDWFHLFIFSIP
IPDKIPHVFQASHHSVSASYGIVCKLKRNCTLQIWDHAISWRETNLYLSSAMCTLPPFIRNSLLGLMKLTSCLILHHADQ
ILPCADFFNPGWEIEIGSAKGQLTHRNVFKRKVDPIVNGITDMTKFAPVTEIKAKTPTVTMLSHVWFAKDIKTALLAADI
ITNEWGFKDYKLDIYGALNKSPVYSSECQEILACKGLGQNVTMRGTADPAMVLANTWLFLNSSVSEGLPLALGEAALTGA
PVVCTDVGASLRVLTDPDDGKRYSEVVAPNDAYGLARAQINLLAMLDEWAQYAEDGPGVAAPVLPHKPTPKDVEIITRRM
YEKSDHRRKLGMMARNIVQKSFGGERYLREHEQMLWIGKSFYEMLDFEKQTPPPRNPARMLSLGRTRTVPQRDTMDTTSS
SIFDPQMEKMMHPRRPFAQHRASAATSFSSVYIDDEDDSGPSSRYSPDLPWESEAWDTQPGSAGASTKYATSESDEWALP
VIPRPTRTYSGTHIAPMRTPSSSVAPAKGKRPMQFQYAGSMAREDTGNGMLDPRRDVLARQSWAPNSGRSSLRRSHLNEM
ELA
```

Fig. 99
BASE SEQUENCE OF NUCLEIC ACID MOLECULE OF Bipolaris maydis gtb3 (Gene ID: COCHEDRAFT_1146218)

ATGGCAAAGCCCGACGTTCTAGGTATCGAAGCCTTCAAGGATGGCACGCGAATCCGGGACTGGTGGGATTGGACTCTCAT
TGCCATCATTGCTGCCAGCGGATTTGTCGGCCTTGTCGCTCTCGTTTGGTCGACTTATCGTTCTCTTCGAAAAGTGCTCA
AGGTATGAAAAGCTGCTGCACCGACATGCGCCCAAACTGACAAATCCTGCAGGAGGATGAAGACGAAACTGCCTTGCCAC
GGTCTGTACAAGAGCGCATTCATCTCCTGTCAAACAGCTCAAGCGTCGTTCGTGTTACGCACGCGCTCCCCGCCAAACCT
TCATCTTTTGGCGTCTACCTTGGCGCATTGCAAACCCCAGTCACTCCAGAGGAGGCCCAGGTTCTATCGCAATGGGAAGC
GCTCGTCTTGGATTACCGGCAGACTGGTATCCTGGAGGCCGTCAGCAATGATGCTGTTCCCATGGGCCCTTACATTATCG
CGCGACTCGATCTATCCCATGTTATCACTTCGGCCGTAAAGGGCACTGAGTTGGACCTGTCACAAGCAATATATCTCTTG
TCTTGCACAATCGAACAGAACTTGCGACGGCCAGACCAGAAGCGATACTTCACTGGTGTTCTCATTGCCGAATGGCGCAA
CCGCGTTCCCATCGCTTTGCTGCATGGCCTCACAAAACTTCTTTCAGCCCATGGCTTGGATAGTTATCTGGAGATCGGTG
CTCCCGACTTCTTGGATGGTGTAAAGAAACTCGACCTCTCGCTCTTTGCCGGCGTAGTGGTTCGCAATGGTACGATCAAG
TCGAATGGCGAGCGTCGCGATTTCTTCGACATGGACAAGATGAAGAGGACAACCAGGTCATTTGTTTCCCAAGCTTGCCA
ACGTTCATTTGTCACAATGATGTGGGATACAGTGGATGATAATGCCGAACTGTCGCATGCTGTTCTTAGGAGAGCGCACA
TGTGGTGCAGTTATCACGGCGCAGTGCCCTACTTCCCACGGCAGTGCGCCCTAACCAACATCTACGATGTCAGCTCCTGC
GAGGAGCCCTTGGCCGCTTTCCAATGGTTGAAGACTCGAAAGGTCATGGATGTTCATGACAAGTACCGAACTGCTCGTAC
GATTTCGCCTGGATTTTCCAGTCTTTTTGACGACTACGTGCCGCTACAAGAAATTTTCCCTCTCTTGGCTGACACGCTCG
CCGGCCTTGATGGAGACATGCCTAACGACGACGACTCATCCAGTACCCTTACACTTACTGTGGAGTATCCCGAGGTTGAT
GAGAATGGAGTGTTGGTTCGCCAAGAACCCTCATCACCCACGAGTTTGGGGCTCGACTGGACCATGGCAGTGGAAAAGCA
CACCGACAACCCACTTTCATGTTCTTTCGACGGATCACCATATTCATCTCTAGGGTGCTTTCCAATTGGTATTGATGCTT
GCAAAGCAGATTTGGATCGCGTCCTCAAGTCACAGCGGCATCTGCGGGATCTCAAGTTGCTTAGCCGTCTCCCTGTGGAA
CAGTTCAGTGCCACTGCTGAGACACTCAGCCGCTACGCTTCTAGCAGCAGTCACTTTCTGAACCTTGTCCCTACTATGAG
AGAGGCTATATTAGCTCTTGTAGAAGCATTGGACCATGCTGTTGAGGATGGTGCCGACCCTTACCGATTCCAAGCATATT
CTGCACTTGATTCAGGATTTCATACTCCCAACGGCGCCTCATTTTGGGGAGTGTGGGAACTAGACCCTCGGACTAAAGCT
ATCATCATATATGTGTCCAAATCTGTACAGGATGTCAAAGGAGTTCTGCTTCACACATACCTGAGTATGATGGGCTTTTC
TAGGTACCAGTGTTTCCTTGCGGAATACGGTCTTAGCGAATTTGCTGCCGGATCATTTTCACCAGAACGACTACCGGATC
GGCTAGTTCAAGATCTGGATCTTCTTTCGTCCTCAGAGCTTCTAAATTACCTGCAGCATATTCGTTATTCAGAATGGGAA
GAGGAATGCTCGCTGCTCCCTGCGATTCGCGAACGCTGTAAGGAGTTGTTGATTGATGTACCTACGTATCATCAGTTTAA
GCAACTGAGCAACGTAGACTACATTGGCGAAAAAGTCACCGACGAGGAGCTAGTGAACGCGAAACTCAAATGGTATCGAC
TCTCGCGCGTGCCGACTCTTGATGAGGCGCAAGCTTTACAACTCTTCAGACACATCAATGAGGTGTTTACCAGCATACTA
TGGTGGAGGGATCACCAGAAGCTTGATACCATCACTTCAGCCATCACAGACATCACCAGCCGGGGAACACTCGACTCGGC
GGCTGACTTTGTCCTTTTCTGTATCTTCTGTGCAGCCAGGAAAGCCGGATTCGAAGAAGTCTACATTGAGGTCTCAGACA
GGAACCCACTCTTCAACCAGTATTCCGATCAGAGTGCGGCATTCGCAGAACTGTTTGCGCTAGGATCTCGATGTGAAGCT
TATTTCGATATCAAGCCTAGCGACATGGGTATCTTGCTATCGGAGAAACATAGGGCGTACTACAACCAAGAAGAACACCA
GCCTCCGATGTGGATCTTCAATGCGCCTTCATTTGCCTCCGCTTATGCTGCAGCCCAGACAGATATCGACCCTGAGCAGA
AGGCCTCCGTCATGCCTGCCTATCGTCGCTTTACTTTCCTCAGTGTCTTCGCAATTCCTGCCCTTGTCGATATTGTGCTT
CTCTCCACTACCGGGCACGGCCTTTACCTCAGTGTGAGGATGACTGAAGACGACAGGTACTATGCTACGCTGGCATTGAT
GTGCTCATTGCTGCTCTCTGGCGCTATAGGAACTTGGATCTCTATTGGTGGCACATACTACCTCATTTCCATGGCATTCT
CCGCAGCCAACATGTTTGTCCTCACACGATTGGTTGGTGGCCTGGCTTTTACTCTTGCTGGATGTCTTCTTGGATTTATC
GTCATTTCGGCTGTATCAGGACCCGGTCACGGCGCCGTCTTCTTCTTCTACCTCTTTGGACTGACTACATACCTGACCGT
CCTGGCTGTGCTTTCCACGTATCAGATTCCTGGATCCAGCTTCCTCAACGGCCGAAAAATCATCATTATGGTCATTCCAA
CCTTGGTGATCTCCCCTATTCTGACCATCTTCATTGGGATGAAGGGCCATGACATTTATCTCTATCTGGGTGTTTTGTAT
ATCTTCGTTACCCTTTTGATTCTTGGCACCAGACGCGTGGCAACCCAATGGGTAACCTGGTATCACAACATCAAGACACT
CAACGATTCGGATATCAAGAACTGGTATATGAAATTGCACTCTGAAAGGGAGCAGGAAGCGACCGCCCTCAAAAACAGAG
GTCAAAGCAAGGGTCCAGCTATATCAACTGTCGCGGGCGGATCCCTCGTTGCCTCCTCGGAGGGGTCTTTTAGTGAGCCA
GATATCTTCCAGGGCATGAGCGAACCAGCCATTCTGGCATTGTGCCGCAACGCTCTTCATGAAGCCGTCCTAAAAGAACA
TGGACGTCATTTCTGGCAGAAGTCCACAAAAGATAGCTTCGTGAAACAACTCGCTGGCTGCTGGGATTCGACTTTGTTTT
TGCTGGATTGGTACGCTCGCATAACAGACACCAAGCGACCAATTCCGTACAGTTCGACTTGGAACCTCGAAACCCAAGTC
GCGTTGGAGAGTATGCAACAATCGCAGAAAGGAATTCGTCTCCACAATTCGTTCATTCACTGGCGAACAGCAGGTGATGA
AATCTACTGCGGTATCCTTTACTTCCTGGTCGCACTCATGGACCGTTGGTTGGACATATTGAACGGGGGCCAGATAGTGG

Fig. 100

```
ATATGCCAGGAGCAGATAGTCCTGTTCAATTGTCGGCTGGTCTTGGACTTGCATACGACTTTGCAGGTGAGATGGACACG
GCGCTCCGCCTATCAGTCGGTTTTGGACTCGCGTACTACCTGATTGGAGCTGTCCTACTCGACTACAAGGCTCAGCATCT
ACACACCCTGTCGGAGCAGATGGCACCCATCTCAATTGAAAACACGCAACAGATCAAACAAGCCAAGGCTAACGATCTGA
AATTCAGGCGTCATCTCTACTTCAATACCTTGTGTCGCTTCATCGGCGTCCATGTGTGGGCGCTTGCTTTCTGCACTGCC
CTCATCTGGATCTTCAATAGCTCGTCCATTGGGCTGACCCTGTTCCTGTCCTACGTTGGTGCTTACACTGGACTCTTGCT
GTATCAGTACAACAAGATCTTCTCTGGCCCGCACGCACTCATGCCATTGCTAGCAGCTGTTGTGGTTGGTTTGATAGTAG
GCAACGTACTCTTGGCGGTCTTCCCTGGTTTCCTCTATGACAGGATTATCGCTCTTGCCGCGTCAACTTGGACAGCAGCC
CTTCTTTCATTCCGAACTGCCAAACTAGGCATGCCAGAAGCTCTAGACTTCAGCAAATGGGTCTCGGAGTCATTTTCATC
AGCCAAGCGTTCCAAAAAGGCAGCAAACACTGTGAATGCACAACCTGATGATGGAACAGAGTCACCAATGAGCGACAAGT
TCCACGCCTACAACAGCGGCAACAGCGATTCCGAATACAGTCAAAGCGAGCTCCGCGCATACTGCAACATGATTCGAGCT
GCTGCAAAAGAGAACAGATACCGTGTCAATCCAGTTGGTCAACCCGGTGATCAAATCGTTGCGTTGCTGCTATCATGCAC
TCACGATAGTCTTTCAAGGCAAGCTTTACAAGCTTTCCCGGCCATGCCATCAACAATTCAGCGAATCGTGTCGGCTTGGA
GAAATGGGCAAATCGATGTCTTCATTGTCCCTCTCCAGGCGGTCGTCAACTTCAATAACGATCTTCGTGCCATTTCGCAC
TTTGCCGACGGTCATTTGACGCTGTATATAACGTCGGATGCGAAGGGCCAGGCTTTGGCCAAACGAACGTGAGCAGCAA
CTGCACTGCTATTGCCGAAACTTTACTTCATGCGTGCATGGAAACATTCCTCGAGACCCCGCACTCACAAGCTGAGATTG
CGGAATCCATTCTTGCATGCAGGGAGAACGACGGTGAGCAGTATGCTATCTCAGAGTGCAACAGACGCTCGATGCCGGCA
TTGGTTGCTGGGCAAGACGCTTTGTCGTATGGAAAGGCCTGCCGCAGAGAACTTTTGCGAAATTTGTGCCTTGGATTCGA
CTGTGAAACGCAGTGGGATAGCTTGCCATTGGACATACGACGACTGTTTTTCCGACGTTGTCTCGGCATCCGAGCACCTT
ACACGAACAAGGAACTATCCTGGATCCACGAAAACATCCGCACCGAAGAGTCCTGTGCAATTCTCTCAGTCATCGGCACGC
TATGATCTAGGAGCCTACTTGGCAGTTGTCAAGTACAGCTACTTTAGGAATCGAGGCGATCAATCACTCTCCAACAAAGA
ATATCGTCAAGTCACTGCGGATATCCAAACGGCGTATCATCCGGTCCTCAATCGCTCCGCCGTTTCGATGTTTAGCTTGT
TCACTGAATACATCCGCCTTCCGGTTGCTTATGTGTATCACTGTGCTGGAACCTGGGTAAAGTTCTTTGTTCTGGCGTGT
ATGGCCGATCCCGAGTATCAGCGTGAGCTGAACGGGGCACTACTGCACAAACCGTGGATCGTTGCCAAGCCAACTACATT
TCTTCTCACGGGACTGTGGATATACAGCCGACGTGCAATGTCCATAGCTCTGCCGTTCTTCCTCTACCATCGTCGTAAAG
ATATTGCAGGCCTAGCAGGAACCGTCAAGGGAAGTTTGATCATCCAGAGAAAGAACCGCTTGGTCATTCAAAGTGCCGGA
GAGACTGAGACGGCTTTCGTCCACCCTGACAAAGACGGCGGCTTCAAGTTGATCTTCTATTCAGGCGCTCTCAAAACCGA
GCCGACTTGGGGTCAGATTCGTGTTTCTCACTACGATAAAGAGATGCGCATCAAGCTACGACAAGAGTGGAAGAATGGCT
CAGTCACCAATGAGTTTACTTACGAATATGAAACGAACCAAACGCAAAGCAAGATCAAGATTTCCAAAGTACGGTCAACC
AAGATCCCCCTCAGCCGGATTTGCGGCAAAGGCGAAAACGACGGAGCAAAGGTCTTGTACAACCACAAAGGCCATATTGA
ATCTGGAAGTTACATCAGCCACAACAACCTTGTACGCTTCAAATACCACTACCGAAAGAACGCCAAGTACGACGATGAAC
TCCTTCGTGCCGAGTTCGTGCTTCCACATATGTCGGCCAATGTCAGCTGGTGCGCGGCCTCCTGTTCGCCATGCCGAGAAG
ACGGAGCGTTGGATACCTACCCCACGTGTGCATGAAGCGACCTTCGTCCAAGGTGCCGACGTTTACGAATGCACATGGTT
TTATGATCACAAGTTCCACCCAACGATTACAACCAAGCTCAACGGCATAATGGTTGATACACCAGACATGATCCGTCACG
ATTGGCTTGGTGTTCTCAAGAAGCCCACCCGCTGCACTTTCGCTGATGAAAACCCTCTACTGGCATTCAAAACTCCGACC
TCGAACTTCTTGGGCCGGTTGTTCCGAAGGAACATCAAGCAGCAAGACTCTACTTCGAGAGCTCGATCTCATCTCTG
GAAGGCTTGGAAGAAGCGTAATGACCTTGATGGAGTCGTCATTCGCTGGGTCGACGAGGAACTGATCCGGAAGGAGGCTC
TGCTAAGACCTTACTGGAGACGCCGTGATCGTGGAAGTCTGGTCAAAGCAGAAGACTACCTTGCCCTACACGCCGATGCC
ATCATGGCCAGCTCAGATCTCACTAGCGATATCAGCGCGTGGACCCCTCTAGCCATCCGCATGAGCGACCTGTTCAGTTT
CGGTCAAGGTGGAGATGCTGTCGTTTTCACCAGGACTAAGGCACTGCAACGCGATACCGATAACTCACTACACGTCATTG
CTGTCGACACTGGAACCTGGCCAAACGAAGGTGGTGGTGTCTCAGCATGTCGCCGAGATCTCATCAACAACCTTCGCACT
ATCAAATGGCACATGGTCGTGGAATCAGCTAACGACTTTGGACTGCCAAAGCATCAGACTGAGGAGAACGTCGAATCCCT
GAAGATCATTCCCCTATGGGGCCTGGACTTTATGCATCCCAACCACGGCATGTTCACCAACAAGCTGGACAGCGAGGTTG
ACCATCTCGTCAAGGCAGCAACTTTGACTGACATTGAGACAAACTTCATTCCTACGCTGACCGCTCTTGTCCGCGGAGCG
CGAGCTACTACCATGACTTCTGCAGATGTCAAGCAGGCAACACGTGCTTTGGTTAACCTCAACACATACTTCCAAGATTC
GCGCCACTGGAAAGAGGTTTGGACTAGCGACATCGTCAAAGACTCTTGGAGGAAGCTGTGGCTGACAGACGACATGCCGA
ATGCCCAACCGGCAAAGGATTGGTTCCGTACCGAGTTGCCAACACTTGGCCACTTTGACACTGCTTTGGAACTGTGGTAT
AGGTGTAAGTAGAAGCTGCCAGCGTACATTGAGTGAAACTAACATTTACAGATCTCTTCATCTTCTCCATTCCGATCCCC
GACAAGATCCCGCATGTTTTCCAAGCCTCTCACCACAGTGTCTCTGCGTCTTATGGTATCGTTTGCAAGCTCAAGCGCAA
CTGTACTCTCCAGATCTGGGACCATGCCATCTCCTGGCGTGAGACTAACCTCTATTTGTCATCGGCCATGTGCACTCTAC
CACCCTTTATCCGAAACTCGCTGCTAGGCCTGATGAAGCTGACCTCGTGTCTCATTCTTCATCACGCCGATCAGATCCTT
```

Fig. 101
CCATGTGCAGGTACGTATATATATCCCTTGAGTTTGTCGCTCTCAACTAACTCCTTTCTCTCAGACTTCTTCAACCCAGG
ATGGGAGATTGAAATTGGAAGCGCAAAAGGACAGCTCACACATCGCAACGTCTTCAAGCGCAAGGTCGATCCTATTGTCA
ACGGTATCACTGATATGACAAAGTTCGCTCCAGTCACGGAGATCAAGGCAAAGACACCAACTGTGACCATGTTGTCCCAC
GTCTGGTTTGCCAAGGACATCAAGACGGCTCTGCTGGCCGCCGACATTATTACAAACGAGTGGGGTTTCAAAGACTATAA
GCTTGACATTTACGGTGCTCTCAACAAATCTCCTGTCTACTCTTCCGAGTGTCAAGAGATTCTCGCCTGTAAGGGTCTGG
GCCAGAACGTCACCATGCGCGGTACAGCGGATCCAGCAATGGTTCTTGCAAACACCTGGCTGTTCCTCAACTCATCGGTT
TCCGAAGGTCTGCCTCTCGCACTTGGAGAAGCTGCGTTGACTGGAGCCCCTGTTGTCTGCACTGATGTGGGTGCGTCTTT
GCGCGTGCTCACCGATCCCGATGATGGAAAACGTTACAGCGAAGTTGTTGCTCCAAACGATGCATACGGCCTGGCTCGCG
CCCAGATCAATCTCCTCGCCATGCTAGACGAATGGGCACAGTATGCCGAAGACGGCCCTGGTGTCGCTGCTCCAGTCCTC
CCCCACAAGCCCACACCCAAAGACGTCGAAATCATCACCCGCCGCATGTACGAGAAATCCGACCACCGCCGCAAACTCGG
CATGATGGCCCGTAACATTGTCCAAAAGTCGTTTGGCGGCGAGCGCTACCTCCGCGAGCACGAGCAAATGCTCTGGATTG
GCAAGTCCTTCTACGAAATGCTCGACTTTGAAAAGCAAACCCCTCCGCCCCGAAACCCAGCGCGCATGTTGTCGCTTGGC
CGCACCCGCACCGTGCCGCAGCGCGACACCATGGACACAACCTCGAGCAGCATCTTCGATCCGCAAATGGAAAAGATGAT
GCATCCCCGTCGTCCTTTTGCTCAACATCGCGCTTCGGCTGCTACGTCCTTTTCGTCCGTCTACATTGACGACGAAGATG
ACTCGGGCCCTTCATCCCGCTACTCGCCCGACCTTCCCTGGGAATCTGAAGCCTGGGACACGCAGCCCGGCTCGGCTGGC
GCAAGCACAAAGTACGCTACCTCTGAGAGCGACGAGTGGGCTCTCCCTGTTATCCCGCGCCCGACTCGAACGTACTCTGG
CACGCACATTGCGCCGATGCGTACACCGTCGTCGTCGGTGGCTCCCGCCAAGGGCAAGCGCCCCATGCAGTTCCAGTACG
CGGGCTCCATGGCTAGAGAGGACACTGGTAATGGCATGTTGGATCCCCGCCGCGATGTCCTGGCACGACAGAGCTGGGCG
CCTAATAGTGGACGGAGTAGTTTGAGGAGGAGTCATTTGAATGAGATGGAACTCGCCTAA

Fig. 102
PUTATIVE AMINO ACID SEQUENCE OF Botrytis cinerea ags1 (Gene ID: Bcin08g02140.1)

MLARTFVALCSVLLSTQVDALRYEEEFVGYNLNTNQTATSPFDYYGKWEDHEFFQSPDNWRFPFYSFFLDKFVNGDPTND
DINGTKFETDFMQTQLRHGGDLQGLIDSLDYIQGMGIKGIYIAGSPMINAPWGADQYSPLDFSLLDQHFGDIDLWRKTTT
AIHDRGMYVMLDNTMGTMGDLIAFKGYENSSTPFTLTEHEVLWRNDNRQYLDFSFGSKYNETCNYPRFWLDTGYTVKEDV
TDLMNGCYDSEFDQYGDTEAFGVFPDWQRQLSKFASVQDRLREWVPSVRTKIEIFTCMIIQQLDIDGLRVDKATQITVDA
LGSFSHAIRECARDVNKTNFMVTGEITGGNTFGSIYLGRGRQPDMLPSSMADAVKLTSNSSLAYFIRDHDQNALDSAAFH
YSVYRTLTRFLGMDGNLASGYDTPTNWVDAWNEMLVTNDFVNPNTGVFDPRHMYGVSNQDVFRWPAIQNGTQKQLLGFFI
TTIHMPGIPLLLWGEEQAFYVLDNTADNYLFGRQAMSPSQAWQTHGCYALGSGTYYQFPNDSCTRGCNDDWNSRDHRDPS
HPVRNIVKAMYQMRDNYPVLTDGAFLRQLSNQTIEILLPGSNGTATETGMWSTMRGQYDGIQDLSKAGGQANQSVWMVYH
NNYDTVTYSFDCSSNETSLVAPFLDGVTVKNLFYPYEEVTLKAGPFQLGIANQTGFNGCLDSLTLVPYEYKAYVPKKSWV
GPSPMITSFSPGHDARLVSTVAPGEQETIEIEFGFSAEMKCSDLISKMVITSATEDGQVATLANATGEYSCTLLPSAVNV
TEFVGSIPTMWTFKGNLTNVSNGVHSITLANITSNSGNSSTGATDTFLFRVGQVDNPIAFPGSANFTRELLHKYDNGTLY
VSHKAAGADRFKYSLNWGSSWSEWLPYVGGNTTLEPQAWTGTSKQKWDGDHVIMQYWSKLTGSSDVVQHADLETNKWSRR
LPHLFANGPYNQYGYDTGIDNGFTLNKKDSLWEYKFMTEWPAVMQVNVWGMNPDGQPDETIVLGDIDNDNILDRMPPSSL
STALINITRVPPSPYLGYKIAIDDGNYRYYQIPYGNRSYQMLMVVLFWIVPVLSGGLSIWLFMKSFYAVKLNSVGVKEAK
NYIPLALRRKLKREKKEDPSEKEMTVMGGLHSMFHENATQLGLQADVAATGRRTVLIATMEYDIEDWAIKIKIGGLGVMA
QLMGKNLGHQDLIWVVPCVGGIDYPIDHQAEPMDVTILGNSYTVQVQYHTLRNITYVLLDAPVFRAQSKSEPYPARMDDL
DSAVYYSAWNQCIALTIKRFPVDLYHINDYHGAVAPVHLLPETIPCCLSLHNAEFQGLWPMRNQKERSEVCQVYNIPEEV
AIKYVQFGDVFNLLHAGSSYLRIHQKGFGAVGVSKKYGKRSWARYPIFWGLSKIGNLPNPDPSDTGDWNGTQDSTGKTIV
NQDFESQRADLKRQAQEWAGLEQNPKAELLVFVGRWSMQKGIDLIADVMPAVLEENPNVQLICVGPVIDLYGKFAALKLD
VMMTKYKGRVFSKPEFTALPPFIFSGAEFALIPSRDEPFGLVAVEFGRKGALGIGARVGGLGQMPGWWFTVESTTTTHML
HQFKQAIKEALASKLETRQIMRARSAKQRFPVAQWVNDLEILQSKAIKIHDKEEAKHSGRPRSRGRDGGNIFYSSAKRLS
SFGTSFASTSQLDVASTIGGSTRPSSPTRVEQPPAGGGLSRKLSLGYRAGPGHRVTKNRFNGSNAPGAGIKNDEGLTDVD
EDSDDEDARIRDDIYDEYVLTPEELEAQRQQEQWRGQAESPAAGGAFLAPQPGFLDSPRRSPSANTGSLHINDSELSLPR
LKDGSNIYSTHSIPGSPGLESPGTPGAHDSLLPPPSIFGAGGDNANRASMLSLSSVIGDKTDFKLQKVDPFFTDTQGEYY
QQFARNLDNLDGKNSEGGQLCIEEYLIKSEKKWFDRFRDAKLGRNSVAPSFSALGSGRRSHDSRGRSNSRDSFTNDTITHS
RQNSSQDNMALTGGSTANDQFLLGKDYKPPTGLRLVMQYRFFDWPVYSFLLAFGQIIAANSYQITLLTGTVGQSAEKLYI
TATIYLVTSIMWWEVFSFFKSIYVLSIPFIFYGLAFFLLGMAPFVDGADGRGWVQNVATGLYAVAASSGSIFFALNFGDE
GGSPVKAWVFRACIIQGTQQAYVVILWFWGSYLNRRQADGLGTSFTSASPKMSAVVLPIAVLMWAVGLITFLGLPEYYRQ
APGKVPSFYASLFRRKIVMWFFVTVLIQNFFLSTLYGRNWLYLFSSNHAPTWAIILLIIFFFGFLWAGFLWFFAILSKDH
SWVLPIFAIGLGAPRWCQMLWSCTPIGQYVPWVGGGLASAIFSRSLWLWLGMLDALQGVGFGMLLLQTLTRVHIAFTLIA
AQVLGSIATMVARACAPNKIGPGTVFPDFSDGAAGLGNGWFWIGLILQLVICGGFFTFFRKEQLSKP

Fig. 103
BASE SEQUENCE OF NUCLEIC ACID MOLECULE OF Botrytis cinerea ags1 (Gene ID: Bcin08g02140.1)

```
ATGCTCGCGCGAACTTTCGTTGCCTTGTGCAGCGTCTTGTTGAGTACACAGGTCGATGCTTTACGTTACGAAGAGGAGTT
TGTGGGCTACAATCTGAATACAAATCAGACGGCAACATCACCTTTTGATTACTATGGAAAATGGGAAGATGTACGTGAAA
ATTCGTGGCTCTTGGAGCGTTAAAAACTCCAGTGGTGAATTTTTGAATATCCAGATGTACATTGGCTGACCTATCTTTTC
GTAGCACGAATTTTTTCAATCTCCAGATAATTGGCGTTTTCCCTTCTACTCTTTCTTTCTGGATAAATTCGTGAATGGAG
ATCCAACGAACGACGATATCAATGGAACCAAATTCGAAACTGATTTCATGCAAACCCAATTACGACATGGAGGAGATCTA
CAGGGTCTCATTGATAGTCTGGACTATATACAAGGAATGGGAATAAAGGGAATTTATATTGCTGGAAGTCCTATGATCAA
TGCGCCTTGGGGCGCTGATCAATACTCTCCTCTGGATTTCAGTCTTCTCGACCAACATTTCGGAGATATCGATTTGTGGA
GGAAAACTACCACTGCCATCCATGACAGGGGAATGTATGTGATGCTCGACAACACCATGGGAACCATGGGAGACTTGATT
GCTTTCAAAGGCTATGAAAATTCTTCGACTCCGTTCACCCTGACCGAGCACGAAGTCCTTTGGCGTAATGACAACCGCCA
ATATCTGGATTTTTCCTTCGGGTCGAAGTACAATGAGACCTGCAACTACCCTAGATTCTGGCTTGATACTGGATATACCG
TCAAGGAAGATGTCACTGACCTCATGAATGGGTGCTATGATTCCGAATTCGATCAATATGGTGATACCGAAGCTTTTGGT
GTCTTCCCTGATTGGCAACGTCAGTTGTCAAAGTTCGCCTCTGTCCAGGATCGTTTGAGAGAATGGGTTCCATCCGTAAG
AACTAAAATCGAGATCTTCACTTGCATGATCATCCAACAATTGGACATTGATGGACTGCGTGTGGACAAGGCGACACAAA
TTACGGTCGATGCATTGGGAAGTTTCAGTCACGCAATCAGAGAGTGCGCAAGAGATGTGAACAAGACAAATTTCATGGTT
ACTGGTGAAATCACTGGTGGAAACACTTTTGGAAGTATTTACCTCGGGCGTGGACGTCAACCTGACATGTTACCGTCCAG
CATGGCAGATGCGGTTAAATTGACCTCCAATTCTAGTCTGGCATATTTTATCCGTGATCACGATCAAAACGCGCTCGACT
CTGCTGCTTTTCACTATAGTGTTTATCGCACACTGACCAGATTTCTGGGAATGGACGGAAACTTGGCAAGTGGTTATGAT
ACACCAACTAACTGGGTAGATGCGTGGAACGAAATGCTTGTAACGAACGATTTTGTTAACCCTAATACTGGAGTGTTCGA
TCCAAGACATATGTACGGAGTCAGCAATCAGGATGTTTTCAGATGGCCAGCTATCCAGAATGGCACACAAAAACAACTTC
TAGGGTTCTTCATCACGACTATACACATGCCTGGTATTCCTTTGCTTTTGTGGGGTGAAGAACAAGCATTCTATGTCTTA
GACAATACAGCCGACAATTATCTCTTCGGTCGACAAGCTATGTCTCCTTCTCAAGCATGGCAGACTCACGGATGCTACGC
CCTTGGCAGTGGTACATATTATCAATTCCCCAATGACTCTTGCACTCGAGGTTGCAATGATGATTGGAACAGCCGCGATC
ACAGAGATCCATCTCATCCAGTTAGAAATATTGTCAAGGCAATGTACCGATGCGAGACAACTATCCAGTTTTGACCGAT
GGAGCATTTTTACGACAACTTTCCAACCAGACAATCGAAATCCTCTTACCAGGTAGTAACGGAACAGCTACTGAAACTGG
AATGTGGAGTACCATGCGAGGTCAATACGATGGTATTCAAGATTTATCTAAAGCTGGTGGTCAAGCAAACCAGTCTGTTT
GGATGGTTTACCACAACAATTATGACACAGTTACATATTCTTTTGATTGCAGTAGCAACGAAACCTCGCTTGTTGCTCCT
TTCCTTGACGGTGTCACTGTCAAAAATTTGTTCTATCCGTATGAGGAGGTTACATTGAAAGCAGGTCCTTTTCAGCTAGG
AATTGCAAATCAGACTGGCTTCAATGGCTGTCTCGATAGTCTCACTCTCGTTCCATACGAGTATAAAGCGTATGTGCCAA
AAAAGAGCTGGGTTGGACCTTCGCCTATGATTACCTCATTTTCACCAGGACACGATGCACGACTTGTTTCTACAGTTGCT
CCCGGAGAACAAGAAACCATTGAAATTGAATTTGGCTTCAGTGCCGAAATGAAGTGCTCTGATCTCATTTCGAAAATGGT
AATTACCTCGGCAACAGAAGACGGACAGGTTGCAACACTAGCCAATGCCACCGGTGAATATTCTTGTACTTTGCTTCCAA
GTGCGGTCAATGTAACCGAATTCGTCGGATCAATTCCAACCATGTGGACTTTCAAAGGAAATCTTACCAATGTATCCAAC
GGTGTCCACTCAATCACTCTAGCCAATATCACCAGCAACTCTGGAAATTCCTCAACTGGAGCCACAGATACATTCTTGTT
CCGTGTTGGACAAGTTGATAATGCTATCGCTTTCCCCGGTTCCGCAAACTTCACAAGAGAATTACTTCACAAGTATGACA
ATGGCACATTGTATGTCAGCCACAAAGCTGCTGGAGCAGATCGGTTCAAATATTCTTTGAACTGGGGAAGTTCATGGTCT
GAATGGTTACCATATGTTGGTGGAAATACCACACTTGAACCACAGGCTTGGACTGGTACAAGCAAACAAAAATGGGACGG
AGATCACGTCATCATGCAATATTGGAGCAAACTTACTGGTAGCAGTGATGTAGTTCAACATGCTGATCTAGAAACCAACA
AATGGTCGCGTCGCCTTCCGCACTTGTTTGCTAATGGTCCATACAACCAGTATGGATATGATACTGGTATCGATAATGGT
TTCACTTTGAACAAGAAAGACAGTCTCTGGGAATATAAGTTTATGACTGAATGGCCAGCCGGTAAGTTGTATCTTCAATC
CGATGTATCAAGGCACTCTAACAATTTCTAGTCATGCAAGTGAATGTTTGGGGTATGAATCCTGATGGGCAACCTGACGA
AACTATCGTGTTGGGAGATATCGACAATGATAATATCCTTGATCGTATGCCACCTTCATCGCTATCCACGGCGCTCATCA
ACATCACACGCGTGCCACCATCACCATATCTCGGATACAAAATTGCAATCGACGACGGTAATTATAGATACTATCAAATC
CCTTACGGAAATCGTTCCTACCAAATGTTGATGGTTGTCCTTTTCTGGATTGTCCCTGTACTCAGTGGTGGTCTCAGTAT
CTGGCTGTTCATGAAATCTTTCTACGCCGTCAAACTCAACAGTGTCGGTGTCAAGGAGGCAAAGAACTATATCCCATTAG
CCTTGCGCAGAAAGCTGAAGAGAGAAAAGAAAGAGGACCCATCTGAGAAAGAAATGACCGTCATGGGAGGATTGCACTCA
ATGTTCCACGAAAATGCCACACAACTTGGACTGCAGGCTGATGTTGCAGCGACCGGACGGACGAACTGTACTTATTGCTAC
TATGGAATATGATATTGAAGATTGGGCTATCAAGATCAAGATTGGTGGTCTTGGTGTCATGGCACAATTGATGGGAAAGA
ATTTGGGTCATCAAGATCTCATTTGGGTCGTTCCTTGTGTTGGTGGTATCGATTATCCTATCGATCACCAAGCTGAACCT
```

Fig. 104

```
ATGGATGTCACAATTCTTGGAAATTCCTACACTGTTCAAGTTCAGTACCATACTCTACGAAACATGACTTACGTTCTTCT
CGATGCACCAGTTTTCAGAGCACAATCTAAGTCTGAGCCATACCCAGCTCGTATGGATGATTTAGACTCGGCCGTTTACT
ACAGTGCTTGGAATCAATGTATCGGCTCTTACCATCAAGCGTTTCCCCGTCGATTTGTATCACATCAACGATTACCACGGA
GCCGTTGCACCAGTCCATCTTCTTCCAGAAACGATTCCATGTTGTTTGTCCCTCCACAACGCCGAGTTCCAAGGGTTATG
GCCCATGCGTAACCAGAAAGAGAGAAGTGAAGTCTGTCAAGTCTACAACATTCCAGAAGAAGTCGCCATCAAATACGTTC
AATTCGGAGATGTGTTCAATTTGCTCCACGCCGGAAGTTCTTATCTTCGTATTCATCAAAAGGGTTTCGGTGCTGTTGGT
GTCAGTAAGAAATACGGAAAGCGTTCCTGGGCAAGATATCCTATTTTCTGGGGATTGAGCAAGATCGGCAATCTTCCTAA
TCCTGATCCTTCTGATACTGGAGACTGGAATGGTACTCAAGATTCAACGGGCAAGACAATTGTTAACCAGGATTTTGAAA
GTCAAAGAGCCGACCTCAAAAGACAAGCACAGGAATGGGCCGGTCTCGAACAAAATCCTAAAGCCGAACTTTTGGTTTTC
GTCGGTAGATGGTCGATGCAAAAGGGTATTGATTTGATTGCTGATGTTATGCCTGCTGTTTTGGAGGAGAATCCAAATGT
TCAACTTATTTGCGTTGGTCCTGTTATTGATCTTTATGGAAAATTCGCCGCTCTCAAACTCGATGTCATGATGACAAAAT
ACAAGGGCCGTGTCTTCAGTAAGCCTGAGTTCACTGCTCTTCCACCATTCATTTTCTCGGGAGCCGAATTCGCCTTGATT
CCATCTAGAGATGAACCTTTCGGTCTTGTCGCTGTAGAGTTTGGTAGAAAAGGAGCTTTGGGTATTGGTGCTCGTGTTGG
TGGTCTTGGTCAAATGCCTGGTTGGTGGTTCACTGTCGAATCTACTACGACAACCCATATGCTTCATCAATTCAAACAAG
CCATTAAGGAAGCCTTGGCCTCCAAATTGGAAACTCGTCAAATAATGAGAGCACGATCTGCAAAGCAACGTTTCCCAGTC
GCTCAATGGGTCAATGATCTTGAGATATTGCAAAGTAAAGCAATCAAGATTCACGATAAGGAAGAGGCCAAACATTCTGG
TAGACCAAGATCTAGAGGAAGAGATGGAGGAAATATTTTCTATTCTTCCGCTAAGAGATTATCGAGTTTTGGTACCAGTT
TTGCTAGTACCTCACAACTTGATGTTGCCAGTACCATTGGTGGCTCTACCAGACCATCATCGCCAACTCGTGTTGAACAG
CCACCGGCAGGAGGTGGACTGAGCCGAAAGCTTTCTTTGGGATACAGAGCTGGCCCGGGACATCGCGTAACGAAAAATAG
ATTCAATGGCAGTAATGCACCGGGTGCTGGAATCAAAAATGACGAAGGACTTACCGATGTGGATGAGGACAGCGATGATG
AAGATGCCCGAATTCGTGACGACATATACGATGAATACGTACTCACCCCTGAAGAACTAGAAGCACAGAGACAACAAGAG
CAATGGAGAGGACAAGCTGAAAGTCCCGCAGCAGGAGGCGCATTCCTCGCACCACAACCAGGATTCTTGGATTCTCCACG
CAGAAGTCCAAGTGCCAATACTGGTAGTTTGCATATCAACGATTCCGAACTGTCGTTGCCACGTCTCAAGGATGGCTCAA
ATATTTATTCCACCCACTCGATACCTGGCTCTCCTGGTTTAGAGTCACCTGGAACTCCGGGAGCACACGATTCTTTGCTT
CCTCCTCCATCAATCTTTGGAGCCGGTGGTGACAACGCAAACAGAGCTTCCATGCTTAGTTTGAGTTCCGTTATCGGAGA
CAAGACAGATTTCAAACTTCAAAAGGTCGATCCATTCTTCACTGATACTCAAGGAGAATACTATCAACAATTTGCCAGGA
ATCTTGATAATCTGGATGGAAAGAACAGTGAAGGACAATTGTGTATCGAGGAATATCTGATCAAATCTGAAAAGAAATGG
TTTGACAGGTTCCGTGATGCAAAATTGGGAAGAAACTCAGTTGCACCTTCGTTCTCTGCCCTTGGAAGTGGACGAAGATC
TCACGATAGCCGTGGACGATCCAACAGTCGGGATAGCTTTACCAACGATACCATTACCCACTCAAGGCAAAATTCTAGTC
AAGATAACATGGCACTCACTGGCGGATCTACTGCCAATGATCAATTCTTACTTGGCAAAGATTATAAACCACCTACTGGT
CTTCGTCTGGTCATGCAATACCGCTTCTTTGATTGGCCTGTCTACTCATTCTTACTCGCCTTCGGTCAAATCATCGCAGC
TAATTCTTATCAAATCACTCTTCTTACCGGTACTGTGGGTCAAAGTGCAGAGAAACTTTACATCACAGCAACGATCTATC
TTGTTACCTCGATCATGTGGTGGGAAGTCTTTTCCTTCTTCAAATCAATCTACGTCCTCAGTATTCCATTCATCTTTTAC
GGATTGGCCTTTTTCCTCCTCGGCATGCCTCCTTTCGTAGACGGTGCTGATGGAAGGGGTTGGGTCCAGAACGTAGCTAC
TGGTTTGTATGCTGTTGCCGCTTCATCGGGTAGTATTTTCTTCGCTTTGAATTTCGGAGATGAAGGAGGATCTCCTGTGA
AAGCCTGGGTTTTCCGCGCCTGCATCATTCAAGGAACACAACAAGCTTATGTCGTCATTCTCTGGTTCTGGGGATCTTAT
CTCAACAGACGTCAAGCTGATGGTCTTGGAACTTCCTTCACATCTGCTAGTCCCAAAATGTCTGCAGTCGTTCTTCCTAT
TGCCGTACTCATGTGGGCGGTTGGTCTCATCACTTTCCTCGGATTGCCAGAATATTATCGACAAGCGCCTGGAAAAGTAC
CATCTTTCTACGCCTCGGCTCTTCAGACGTAAGATTGTCATGTGGTTTTTCGTCACTGTTTTGATTCAGAACTTCTTCCTC
TCGACGCTCTATGGTCGTAACTGGCTTTATCTATTCTCCTCTAACCATGCTCCTACATGGGCCATCATCCTTCTCATCAT
CTTCTTCTTTGGATTCTTATGGGCAGGCTTCCTCTGGTTCTTCGCAATCTTGAGTAAAGATCACAGTTGGGTTCTACCAA
TTTTCGCCATTGGTCTCGGAGCTCCTAGATGGTGTCAAATGCTCTGGTCTTGACACCGATAGGACAATACGTACCATGG
GTTGGCGGTGGGCTTGCCAGTGCTATCTTCTCTCGATCATTGTGGCTTTGGCTCGGTATGCTCGATGCACTTCAAGGTGT
GGGATTCGGTATGCTGTTGCTTCAAACTCTTACTCGTGTTCATATTGCTTTCACTCTCATCGCGGCTCAAGTTTTGGGTT
CAATAGCTACTATGGTAGCCAGAGCATGTGCACCAAATAAAATTGGACCTGGAACTGTCTTCCCTGATTTTAGTGACGGG
GCGGCTGGACTTGGAAATGGGTGGTTTTGGATCGGGTTGATTTTACAACTCGTTATTTGCGGTGGATTTTTCACATTCTT
CAGAAAAGAGCAACTTAGCAAGCCTTAG
```

Fig. 105

PUTATIVE AMINO ACID SEQUENCE OF Botrytis cinerea uge3 (Gene ID: Bcin01p05750.1)
MPGSTNSSSDSGASTPERLSFDNENSAVGTPLTEKSLLFDVDDIDFAVRNAVREAVNDQWILVVGGLGFIGSHTVWELAK
AGYNVAIIDNLSNSFFTVFEKLQLMVDQHYSAPRKNGHRPLLKFHDADFRDMNKMTAILEKYDYPGVMSFDSSSVTLCNG
QRSSISGVIHFAAYKAVEESIQHPLKYYSNNVGGLVDFCALLQQFGIKKMVFSSSATVYGTVADTGVPLREEYVVGSGCS
GLTNPYGRTKWMCEAILSDLANSDPDWEITALRYFNPIGCDESGLLGEDPRAAATNLMPVVLRVLTGALPALNVYGSDYD
THDGTAVRDYIHVTDLARGHLAALSNRPSGGFKVYNLGTGQGYSVLDVVNAMEKATQTKIPTNIVGRRGGDVGKCVALAN
KAEEELMWKTEKSLEDCCNDLWRFLEGTSITKAQAC BASE SEQUENCE OF NUCLEIC ACID MOLECULE OF Botrytis cinerea uge3 (Gene ID: Bcin01p05750.1)
ATGCCTGGCTCGACAAATTCTTCCTCAGATTCGGGAGCTTCCACTCCTGAACGACTCTCCTTTGACAACGAAAACAGTGC
TGTTGGAACTCCCTTGACCGAAAAATCCTTATTATTCGACGTCGACGATATCGATTTTGCAGTTAGAAATGCAGTTAGAG
AAGCAGTTAACGATCAATGGATATTGGTCGTCGGTGGTTTGGGATTCATAGGTAGTCACACAGTCTGGGAACTAGCCAAA
GCTGGGTACAATGTAATGATATCACCCACAAATTTGCGGGTAATCGCTAACAATTGTTATAGGTGGCCATAATCGACAAC
CTCAGCAATTCGTTTTTTACCGTCTTCGAAAAGCTCCAGTTGATGGTCGATCAGCATTACAGTGCTCCGCGCAAAAATGG
ACACCGACCATTACTCAAATTTCACGATGCGGATTTCAGAGACATGAACAAAATGACAGCGATACTCGAAAAATATGACT
ATCCCGGGGTGATGAGTTTCGATTCGAGTTCCGTTACTCTTTGCAATGGTCAGAGATCAAGCATATCCGGCGTCATACAC
TTCGCCGCGTACAAGGCCGTCGAAGAGAGCATAGAACACCCCCTCAAATACTATTCAAACAATGTTGGCGGGCTGGTCGA
TTTCTGCGCTCTGCTGCAGCAATTTGGGATCAAGAAGATGGTGTTCAGTTCTTCTGCGACCGTTTATGGAACCGTTGCAG
ATACTGGGGTGCCACTTCGCGAAGAATATGTGGTGGGGTCAGGATGCTCGGGTCTCACAAATCCCTACGGACGCACAAAG
TGGATGTGCGAAGCAATCTTGAGCGATCTCGCCAATTCTGATCCGGATTGGGAGATCACTGCACTGCGCTACTTCAACCC
GATCGGATGCGATGAATCGGGCTTGCTGGGCGAAGACCCTCGGGCTGCCGCGACAAATCTGATGCCCGTCGTCTTGCGGG
TGCTTACGGGCGCTTTGCCTGCGCTAAACGTGTATGGTAGTGATTATGATACCCACGATGGCACCGCCGTGCGAGACTAC
ATCCACGTTACCGATCTTGCGCGCGGCCATCTGGCAGCTCTCAAGCAATCGGCCAAGCGGTGGCTTCAAGGTCTATAACCT
GGGTACTGGCCAAGGATACTCGGTCCTGGACGTCGTGAACGCAATGGAGAAGGCCACTCAAACCAAAATCCCCACCAATA
TTGTTGGCAGGAGAGGAGGAGATGTCGGCAAGTGTGTAGCACTGGCGAACAAGGCGGAGGAGGAGTTAATGTGGAAGACG
GAGAAAAGTCTGGAAGATTGTTGTAATGATCTGTGGCGTTTCTTAGAAGGCACCTCAATCACCAAAGCACAAGCATGTTG
A PUTATIVE AMINO ACID SEQUENCE OF Botrytis cinerea sph3 (Gene ID: Bcin01p05740.1)
MFFKKKASVIPAKSKVLVPLYIYPSPGAISTYPGLEFIVVVNPHNGPGQLLDSNYRREIQTLNSYPNVTVVGYVSTAYAT
RQYSSVLEDVTTYATWRLEDAGLGVRGIFFDETPSQWSASNASFLANINAAVKGNSGLGAEPLVIHNPGTIPHKKLISGP
CLPDINVVFEATHKTYRENACEKALTDLKMDPGRLACLMHSVPDSLMSTHSDVVSETQKLRSIVGTLYITSQATELYTDL
GEHWEQFIHAVSL BASE SEQUENCE OF NUCLEIC ACID MOLECULE OF Botrytis cinerea sph3 (Gene ID: Bcin01p05740.1)
ATGTTCTTCAAGAAGAAGGCCTCAGTGATACCTGCCAAATCCAAGGTTCTCGTCCCCCTCTACATTTACCCTTCCCCTGG
TGCGTGGGGACGGTTACTTCAAAGGCAAGTCGGGGAGAGCGACGGCATCTTTGGGAATATTGATCATGGGTCTGACTGAA
CAACAGCATCTCTACGTATCCGGGCCTCGAATTCATCGTCGTGGTTAATCCTCACAATGGCCCTGGACAATTACTTGATA
GTAACTACCGAAGAGAGATCCAAACATTGAACTCATACCCTAATGTTACAGTTGTCGGTTATGTCTCTACTGCATATGCA
ACCAGGCAATATTCCAGTGTTCTAGAAGATGTGACAACTTACGCCACTTGGAGGCTCGAAGATGCTGGGCTCGGCGTTCG
AGGCATATTTTTCGATGAAACTCCGAGCCAATGGTCCGCGTCAAACGCTTCATTTTTGGCAAATATTAACGCTGCAGTAA
AAGGCAATTCTGGTCTAGGAGCAGAGCCTCTTGTGCGTGCATTTTCCAATATGTTCTATTACTACTACTGACTGATTGTC
ATCGAGCAGGTCATTCACAATCCAGGAACAATTCCTCACAAGAAATTGATATCTGGTCCATGTTTACCAGATATCAATGT
GGTGTTTGAAGCAACTCACAAGACATATCGTGAAAACGCTTGCGAGAAAGCTCTCACGGATCTCAAGATGGACCCAGGGC
GTTTGGCGTGCTTGATGCACTCTGTACCGGATTCTCTGATGTCCACGCATTCCGACGTTGTATCCGAGACACAGAAGCTG
AGATCGATTGTGGGGACATTATATATCACTAGTCAGGCAACAGAACTTTATACCGATTTGGGGGAGCATTGGGAACAATT
CATCCATGCTGTTAGTCTCTAA Fig. 106
PUTATIVE AMINO ACID SEQUENCE OF Botrytis cinerea ega3   (Gene ID: Bcin01p05730.1)
MSSGGIFKTPLTSSEIAINTPPMASKEQKPVNPHKIFTRKCNIILGLIALFLLAIALALGLTFGLRHHHSSPPASTPTTT
PSNPYPPTNASYWTPNLNASNTWNIELLAALDPANIYANTTIYDIDLFLAANTTPPIIRTLHSQSHKVICYFSAGTIETY
RPDTNRFLPSDYGKQLPDWPNEYWANISSPNVRSIMQTRLDLAVNQSCDAVDPDNVDGYSNDNGLKLTEDDSIDYMQWLA
AEAHGRGLGIGLKNAGEIIDRVLDNVQFAVNEQCVQYQECDTWQAFIDNGKPVFNIEYPKDAPKVSEAEKTRVCDGSDIH
ADGFFTIIKKMELDDWVERC BASE SEQUENCE OF NUCLEIC ACID MOLECULE OF Botrytis cinerea ega3   (Gene ID: Bcin01p05730.1)
ATGTCCTCAGGAGGAATATTCAAAACACCTCTCACGAGCAGCGAGATCGCCATCAACACACCCACCCATGGCTTCCAAAGA
ACAGAAACCTGTTAATCCACACAAGATTTTCACCAGGAAATGCAACATCATTCTTGGTCTGATCGCGCTCTTTCTCCTGG
CAATAGCCTTGGCTCTGGGTCTGACATTCGGTCTACGACATCACCATTCCTCCCCTCCAGCATCCACTCCTACTACTACA
CCATCGAACCCGTACCCTCCTACCAACGCCTCATATTGGACCCCAAATCTCAACGCTTCCAATACATGGAACATCGAGTT
ATTAGCGGCGCTCGATCCCGCCAACATCTATGCGAATACAACAATCTATGACATCGATCTCTTCCTTGCGGCCAATACCA
CCCCCCCTATAATCCGTACCTTACATTCGCAATCCCACAAAGTAATTTGTTATTTTTCAGCCGGCACCATCGAAACATAC
CGTCCTGACACGAATCGCTTCCTTCCTTCCGATTATGGCAAGCAGCTTCCCGACTGGCCAAACGAATATTGGGCTAACAT
TTCCTCACCAAATGTGCGATCCATCATGCAAACACGCTTGGATTTGGCGGTCAATCAATCATGCGATGCGGTCGATCCCG
ACAACGTTGATGGGTATTCCAATGACAACGGGCTCAAACTAACAGAAGATGACTCTATTGATTATATGCAGTGGTTGGCG
GCTGAGGCCCATGGACGGGGTTTAGGGATTGGTCTGAAGAATGCTGGCGAGATTATCGATCGTGTATTGGACAACGTGCA
GTTTGCTGTCAACGAGCAGTGCGTGCAGTACCAGGAGTGTGACACCTGGCAGGCATTCATTGACAATGGTAAGCCCGTAT
TCAATATCGAGTACCCAAAAGATGCACCGAAGGTTAGTGAAGCGGAAAAAACAAGAGTTTGTGATGGCTCAGACATACAT
GCGGATGGCTTTTTCACCATCATCAAAAAGATGGAGCTGGATGACTGGGTAGAGCGCTGCTGA PUTATIVE AMINO ACID SEQUENCE OF Botrytis cinerea agd3   (Gene ID: Bcin01p05720.1)
MVLLYHLVTHILPLSLFLDAALGHRAHRRNPAEADNLPQSESVAVTNPQAIMTSTVPAAPLATVSIGTLAVLANTTVATP
PLAELIATDAVDTVSSKVLVIARDSVSAYSAWSGLNDRGIPYETLIVPAAGVALPTLNSSETHGNYGLIVVMSELSYSYP
DLGYQSAITADQWQAIYNYQTAFRVRLVRLDSYPSAAFGTEALGACCNDGVEQLVHISDNSAFPKAGLKTGATMSTKGIY
HYPTQITNSTLAKEFLQLGASSDGQFTTASTAGVINNINGREQMVFYVPFSTDWAVTSVWLQHAWIDWGTRSLYTGYRRA
LLSTQIDDMFLESDIYSPAGSTYRIGTADLAQHITFMGSVNSKLNAGSNWFIEVGHNGNGNVEKSDEINASESVCSPGPI
EYGEQIDTPLEWVKPLGTGTDIWPKTSVLYPNYTTACLSDDSLLTWWITPSNLNAFAHISHTFTHEDQNNATYADVYREM
TWNQAWLTATGFANAEKFSPQGLIPPAITGLHNGDALRAWADSGITHAVGDNTRAALLNTENEHWPLFTTVEANGYAGIQ
VTPRWATNIYYNCDMPDCTVLEWINTSAGSGDINTLLEVEKQTNVRHLLGLHHDAFMVDWPLITHKHDDLAAIFVNRMTR
DSCGASLSYQLDTTSSSITGFTLSANGNTCSTPLPVTLPGSVTDTQGATVEQIGNDPTTLWVTLSGAPVSFTLTTPIPIT
SS

Fig. 107

BASE SEQUENCE OF NUCLEIC ACID MOLECULE OF Botrytis cinerea agd3 (Gene ID: Bcin01p05720.1)

ATGGTGTTATTGTACCACCTCGTTACCCATATTCTCCCTCTGAGCTTGTTCCTAGATGCAGCTCTTGGCCATCGGGCTCA
TCGCCGAAATCCCGCTGAGGCGGATAATCTCCCTCAATCAGAATCAGTTGCGGTTACCAACCCTCAGGCTATTATGACCT
CGACAGTTCCTGCCGCACCTCTCGCTACGGTATCCATTGGAACGCTAGCTGTCCTTGCCAATACTACTGTTGCTACCCCC
CCTCTAGCAGAGCTTATTGCTACTGATGCAGTTGATACTGTCAGCAGTAAAGTTCTTGTCATTGCACGAGATTCAGTCTC
CGCATACTCTGCTTGGAGTGGGCTCAATGATCGAGGAATCCCATATGAAACCTTGATCGTCCCTGCAGCTGGTGTAGCAC
TACCAACCTTGAACAGTTCAGAAACCCACGGAAATTATGGACTCATTGTTGTTATGTCAGAACTGAGTTACTCCTACCCT
GACTTGGGATATCAAAGTGCAATTACAGCCGACCAATGGCAAGCAATCTACAATTATCAAACCGCCTTTCGCGTTCGATT
GGTGAGACTTGATTCTTATCCATCCGCTGCATTCGGTACAGAGGCACTAGGAGCTTGTTGCAATGATGGTGTCGAGCAGC
TTGTTCACATTTCCGACAACTCAGCCTTCCCTAAGGCGGGACTCAAGACCGGTGCGACCATGAGTACCAAGGGCATATAC
CACTATCCTACTCAAATCACAAACTCGACGCTGGCAAAGGAGTTTCTACAACTAGGAGCCTCTTCTGATGGCCAATTCAC
TACCGCAAGTACAGCAGGTGTAATCAATAATATTAATGGCAGAGAACAAATGGTGTTTTACGTTCCATTTTCCACAGATT
GGGCTGTCACATCTGTATGGTTGCAACATGCTTGGATCGACTGGGGTACAAGAAGTCTCTACACTGGATACAGAAGAGCA
CTACTCAGCACACAGATTGACGATATGTTCTTGGAGTCAGATATTTATTCACCTGCTGGGTCGACTTACCGCATTGGCAC
GGCCGACTTGGCTCAGCATATTACATTCATGGGTTCGGTTAACTCTAAATTGAATGCTGGAAGTAACTGGTTCATTGAAG
TTGGACATAATGGTAATGGAAATGTCGAAAAATCCGATGAAATCAACGCAAGCGAAAGTGTATGTACTCCTTTGATCATG
TGACCCTTACTTCATTCTCTCCGCTTTTCGGTCTCGTTTGCGTTCCAATTTCAGCCCAATAGATGAGCAAAACTAACTTT
TGACTTCAGGTCTGTTCTCCTGGACCCATTGAGTATGGCGAACAAATCGATACACCATTGGAGTGGGTCAAGCCCCTTGG
AACCGGAACCGATATCTGGCCCAAAACATCGGTTCTTTACCCCAATTATACCACCGCATGCTTAAGCGACGATTCTCTAC
TCACGTGGTGGATCACCCCCTCTAATCTTAATGCCTTTGCACACATTTCTCACACGTTCACACACGAGGATCAAAACAAT
GCGACTTACGCCGATGTATATCGAGAGATGACCTGGAATCAAGCCTGGCTTACTGCGACCGGATTTGCCAATGCAGAAAA
GTTCAGTCCACAGGGACTTATTCCACCTGCCATCACGGGGCTTCACAATGGTGATGCGCTTAGGGCCTGGGCTGACAGCG
GTATCACGCATGCAGTTGGAGACAATACCAGAGCGGCTCTCTTGAATACCGTAAGTGTTGCTGCGTGCCGTGTTTTCGGA
AAACCCCTCTTTCTCTTGTTGCACAAACCTTTTTCCACACAAATTTCGCTAATGTGAACACAGGAAAATGAGCATTGGCC
TTTGTTCACAACAGTTGAGGCCAACGGCTATGCTGGTATCCAAGTGACTCCAAGATGGGCAACCAACATTTACTACAATG
TAAGTTCGACTTGATCGAGTAGAATCGCTAAATCTGACACAAATTAGTGCGACATGCCTGATTGTACCGTGTTGGAATGG
ATCAACACCAGTGCCGGATCCGGTGATATAAACACTCTCCTTGAGGTTGAGAAACAGACAAATGTCAGACATTTGTTGGG
TCTTCACCATGATGCCTTCATGTTAGTGCCACATTCCGCTCTTCTCTCCATGAGTGTTTGCTAATTTTTTGAAATAGGTT
CCATCAAGCCAATTGTAAGTTATGGCCCCTCCTGTTGATTCTTCCTCACCACGATTCGCTTGATGTGGTATCCAAACAGG
CCACCATGATAAGCAGTTACTAATTCATTAATGATGTAGTGCGCTACACAGGAGCGGCAACGTACACTATCAATGGAGTG
ACAGCGCAACTTTCGCTGCTCATGGCATGGGTTGAGACCGTGACTCAAGAATTCGTCCGATTGTGAGTTTTGTTTCTGCG
ATGTTTTCATCCGTACTGACCGAGTATAGGGTTGATTGGCCTCTTATCACCCACAAACATGACGACGTAAGTCCTAAGGC
TCCTGTTAACTGTATATCTTCTAACCGGTCATCAGCTTGCTGCTATATTTGTCAATCGAATGACACGAGATTCTTGTGGA
GCTAGCTTGTCATATCAACTCGATACTACCAGCTCATCGATCACAGGCTTCACACTCTCTGCAAATGGCAACACCTGCTC
GACACCGCTCCCGGTCACTCTCCCAGGTTCAGTCACTGATACCCAAGGGGCCACTGTCGAGCAGATTGGTAACGACCCTA
CAACACTGTGGGTCACTTTGTCTGGCGCGCCTGTCAGCTTCACTTTAACCACACCAATTCCCATAACGAGCAGCTAA

Fig. 108
PUTATIVE AMINO ACID SEQUENCE OF Botrytis cinerea gtb3   (Gene ID: Bcin01p05710.1)

```
MAQITGLEAASWGDLTKDWWQFILIAFILASVGLGLSFISYLAFQSSIEAYRKWKSAKQSVPASIKKYLVKTLSELSHYK
VVAVEKKPESFGVYLGGFNHTPTSEDLQVLAQWDLLVVDAFQENVIHVLSSGLYYKPPQVLARLDISLVVPQQCKGSAAL
EGAIAWVTKLLASSTASGSDCRFSGILISNWYDQLPSPMLIEFITFIHKLGFQTYLETSSPGFLRDPKLAELNEVAGLII
RNGTISSNGDERDAFQMQEMRPTIKAFVSQACLRPFVVCLWETLDDGVNPANAIVRRSYQWSKFYSALSPWIGSNSDLTS
TSHGIDQKEPLGAFSWLKEPGVMEAHKKWRLNHTIANEYIPEMTDLAENILGALSIEVDLQPSEKSNQLSFADVDLEMPS
ATPQVLLDLPRNSSDVNLPGFSSRSLTPAESLLSIHAPNRRFSDGPYSYLNQSPGNPISASPGGSSNDFLGCFPLGVHAS
RKSFDEILQSQKKLKSLDLLDPIDNNVLKEIGGKLSQFCNQHGMVELSAWHAAIQELANQLCALADDSAPTDFIRVYKGL
DSGLQYQNESRYWAVFAFEERTKLDIFMSRNVQDLSGTILHTFLSSRGCPRHESFEAEKGFWQWSTQSDSYLPPRLLNDI
SSLSPSELLRFLQTLQLSSVKGNGDLIDSIIFACERELLDSTDFIQMKDACSVGYLGNQKSPQDLIALRSKWHVDNNSQH
PSEENALYVFNQINDAITIVLKERRLNTLQAITKALIEIMEAKKIDARVDIICLALFSVFRKHAFDEAYVEVTDRNTLFN
DQSDQAAAFAELFATGARCESYFDMTPSCFGKLLSDRYRTCHHQPGREPPIWTDADPSTPSAYAAAKIDIGDFKAKGLSG
TMRFTFLSVFAIPALLDILLLTSTGKGLYLSGNMSRTAQHSATLALMISLLISGMCGTWITCGGSYYLISMAFSAMNQFI
ATRIVGGVAFSLAAGLIGLIGLGIKDGIVAGLVFFLYLFALSTYLILLATLANFSYPGTTFQSGRPVILMILPVLFVSPI
TTIFVPGYDIYIYLSVLYVFIFLLALGTRHTASKWTTWHQNIEKISDKELKEWYIKTHKDGDDRAFDGMTDPAALKISRT
AMIEEIRKVRSGFRHNCQDPTVKSLVDSYDATIFLLKWYSGYSGTPLPMPYSSTWNMQIKVALDTLKQMQTGLRLHNAFI
HWRQAGDEVGCSLLYFIVALLDKWNSLLAGGRLLGLSAQNTRYRMPVGFALAYYLIGAVLLDLNAAKLHTMTAESQNMLI
GDVSSIPDAVDAGVKARRHLYWSMLGRYSLFHVWSLAVASSLLWVFDSTEASTLLFIAYVGAYTGLLFYQYTKIFAGPRS
LKPLLIATCVGLPSGQILRHFLPQFEYCDVVALAAATWTAAFLSLYYAGIRAKPVDTMDSEGRIWNKISQDRSFHEFTSP
GRELLLSQDELRMTFENLDALNDDEKYEVDPMTHPGLEIKSILHHAVGIFEEIKGSSVDSIPNFALSAFPEVKALLDETI
TAFESGKIVVECVAMSMFSDEFKDLKAIGCDSSNLMRIIIGCETMDAMDQNSSISLFCQATAEILLHIAAETFQGVSHED
AILLESLLSSVSPSGLLEQTLVPQGLRNFLNFSNPSKADAENVATCFDDEILRHTAIGCNPNIDWEGLPTEIRELILDRC
TGQVDALTTDQHSWVRANKLKGLPIATFLARRNFGAFVATEKKRYTLEFAKTAPVESSDKHEKSNIMNLFGKTQTRRLTA
DLITKQLKWPFSKVYHTIGHCLKLFAIAFVAEPELQRELNYTMKSTPKYMRSIVMFLITGIWSYANFLQGILMPIFLLHG
RKNVETLWKQIRGTTVSLKRQRIMIDSTGGSSTAFVRVPDTASITGSHIINNGREGAEAIQESLLSNGICELRQYGGVLK
QEPADSAKLERISIYSKDLLLLRREDYVKGVKANVYEYEYDLEKISKQNVMTTRRRYPISRRCVEGSNQFEQVLFNKQGL
VQSGSYILDGNLVRFNCHYRQNSNFEDELLRAEFVLPHMFCMVSWAAPPAKRQDKLDTWIPHSQVIEATFVIGPDVYESQ
WSYDHKYHPTIYTTLNGEPVDTPALIEWDHLGVLKKPTNFAFRHDDHMIGFKSLRSHALPRWLGMNTHQNPVSTSKARSR
LWQAWKNNSAYDGVIMRWLDERLLRREPMLRPYYRRRDHGNLRLAEEYLHENADAIMAVIDLDKSISGWAPLAFQIADLY
AFGQGGSANARTRSAPDFKSDELHVLATDSGTWPNEGGGVSACRRDMVNNLKAAKWYMISESANDFGVPKHQTQENVQTL
KVIPIWGLDFMTPTHGIFRDRLDSEVIHAVRDATKLDIQKNFVPILKALVKGARTSQYSNSDILQSTRALVNLNAYFSQG
KHWTGVWNSRIVKNAWRNLWISQDLVSPTPSEGWFQTEIPTIAQLDAALDLWFRYLFIFSLPMPERIPAIFQASHHSVSA
SYGIVCKITRGSTLQIWDHAISWRETNLYLSSDLCSLPPFVRNSLLGLMKLTSQLTLHHADIILPCADFFNPGWEIEIGS
HQGKLEHRNIFKRKIDPVVNGIPPADISKFSPIKETTSPLPTVTMLSHVWYAKDIKTAILAADIIVNVWGFKDYRLDIYG
AIDKAPQYSTDCFEILASKSLPGYVNLCGTASPTDVLKKTWVFLNSSISEGLPLALGEAALTGAPVVCTDVGASLRVLTD
FNTGDCFSAVVAPNDAQSLARAQINMLGLLDEWAPYANDPQGYKPPSIIDKPSAEEVAIITKRMYEKKGELRALGMRSRE
IVQKSFGGNRYLREHEQMLWIGKSRYDIKFPSKQPRPTLRPALPSLAVASNMWGQASIPSAIQTRPMRPSIFRGSSPSIM
ARSMQAASTVVPSPTLERPTSIMGYGSGVKGYQNINDYFAGYRPGDSNASTPDLQFLTPPGIHTPGGNSVRSQSPMRKGA
STRLTMLSRGSTSYDTRSESSSLIVPSKRLPGEDSFLRDLDTALGRV
```

Fig. 109

BASE SEQUENCE OF NUCLEIC ACID MOLECULE OF Botrytis cinerea gtb3 (Gene ID: Bcin01p05710.1)

ATGGCTCAAATCACAGGCCTTGAAGCTGCCTCTTGGGGGGACTTAACAAAAGATTGGTGGCAGTTTGTAATCTTTCCCAT
GCGTCTGGCTGGCTGTTTCGCCCTGTTAATTTTTGAACAGATTCTCATTGCATTTATCCTTGCTTCTGTTGGTCTTGGCTT
GAGCTTCATATCTTATCTTGCCTTCCAGAGCTCAATAGAGGCTTATCGAGTAAGTAAAATAGCAAAGAATATCTTCATAT
CTTATCGCAGACCTCAAAGGTTCATGTGATAAAGCTTCATGGCTGTCAACATCTATAGCTAACGTTCTTCTGTATGTAGA
AATGGAAATCTGCAAAGCAATCTGTCCCCGCGTCCATCAAGAAGTATCTTGTCAAGACTCTTTCTGAACTATCACATTAT
AAAGTCGTCGCTGTCGAGAAGAAGCCCGAAAGCTTTGGAGTATACTTAGGTGGGTTCAATCATACGCCAACAAGTGAAGA
CCTGCAAGTGTTAGCACAATGGGACCTTCTTGTTGTCGATGCCTTTCAGGAGAATGTAATCCATGTTCTATCATCCGGGC
TTTACTACAAACCGGCCACAGGTCCTGGCAAGACTTGATATAAGCCTTGTTGTGCCGCAGCAATGCAAAGGTTCAGCGGCG
CTCGAAGGTGCTATTGCCTGGGTCACCAAGCTATTAGCTTCATCAACAGCGTCAGGTAGCGATTGCCGTTTTTCTGGGAT
TTTAATTAGCAATTGGTATGATCAACTACCAAGTCCAATGCTCATCGAATTCATTACCTTCATTCATAAACTTGGATTCC
AGACCTATCTCGAAACATCATCTCCTGGATTTTTACGCGATCCTAAATTGGCAGAACTGAATGAAGTAGCTGGCCTGATA
ATAAGAAATGGCACAATATCATCAAATGGGGACGAACGGGATGCATTTCAGATGCAAGAGATGAGGCCCACCATCAAAGC
TTTTGTTTCTCAAGCGTGCCTCCGGCCATTCGTTGTCTGTTTATGGGAGACTCTGGATGATGGGGTAAATCCAGCAAACG
CCATTGTCAGAAGATCCTACCAATGGTCAAAGTTCTATAGCGCGCTATCACCATGGATTGGTTCAAATTCTGATTTAACT
TCAACATCTCATGGCATAGACCAAAAGGAACCGTTGGGAGCCTTTTCATGGCTCAAGGAGCCTGGAGTCATGGAGGCACA
TAAAAAGTGGCGCCTGAACCATACTGTAAGCACATCATCCAATATAGCACTCTATCCTTGATCACCATCCAAAAATTTAC
TCCTTGGCCATCCACACCAAACTTTACTAACGCTGGTTCAGATTGCTAATGAATATATACCGGAAATGACGGACCTAGCT
GAGAACATTCTGGGAGCGCTCTCCATTGAAGTCGACCTCCAGCCATCGGAGAAATCTAACCAGCTCTCATTTGCCGATGT
AGACCTTGAAATGCCCTCTGCCACTCCTCAAGTGCTTTTGGACCTACCAAGAAATTCATCTGATGTTAACCTACCGGGAT
TTTCCAGTAGATCTCTCACGCCGGCAGAATCACTTTTATCCATCCACGCACCGAACCGTAGATTCTCCGATGGTCCATAT
TCGTATCTCAATCAATCACCTGGGAATCCCATATCAGCGTCTCCTGGTGGGTCATCCAACGACTTCCTTGGATGCTTTCC
ACTTGGGGTTCATGCTTCCAGAAAATCGTTTGATGAAATCCTCCAATCACAAAAGAAACTCAAATCCCTTGATCTTCTCG
ATCCGATCGATAATAATGTGTTGAAAGAAATTGGTGGCAAATTAAGCCAATTTTGTAATCAGCACGGAATGGTGGAGCTT
TCAGCGTGGCATGCAGCGATACAAGAACTTGCGAATCAGCTTTGTGCCTTAGCTGATGATTCTGCCCCCACAGACTTCAT
CAGAGTGTACAAGGGCCTTGACTCGGGATTGCAGTACCAAAATGAAAGTCGCTACTGGGCAGTGTTTGCGTTCGAAGAGC
GGACTAAGCTTGACATTTTCATGTCAAGAAATGTTCAAGATCTCAGTGGAACAATCTTGCATACATTCTTATCAAGTCGT
GGCTGTCCTCGCCACGAATCATTTGAGGCAGAGAAAGGATTTTGGCAGTGGTCCACACAATCAGATTCATACCTACCTCC
ACGATTGCTCAATGACATAAGCTCTCTCTCGCCATCAGAGCTGCTTAGATTTCTTCAGACATTGCAGTTATCTTCCGTCA
AGGGCAACGGGGATTTGATCGATTCGATAATATTTGCATGCGAAAGAGAATTACTAGACTCCACAGACTTTATCCAGATG
AAAGATGCCTGTTCTGTCGGTTACCTAGGGAATCAAAAATCTCCACAAGATCTCATAGCATTAAGATCAAAATGGCACGT
GGACAATAACTCGCAGCATCCTTCTGAGGAGAATGCTCTCTACGTCTTCAACCAAATCAATGATGCAATCACTATTGTAT
TAAAAGAAAGAAGATTGAACACACTTCAGGCTATCACGAAGGCTCTGATTGAGATTATGGAGGCGAAAAAGATTGACGCC
CGTGTTGATATTATTTGCCTTGCTTTATTTTCTGTTTTTCGGAAGCACGCTTTTGATGAGGCGTATGTTGAAGTCACTGA
TAGAAACACCTTGTTCAATGATCAGAGCGACCAGGCGGCTGCATTTGCGGAGCTTTTTGCAACGGGAGCCCGATGCGAGT
CTTACTTTGACATGACCCCTAGTTGTTTCGGCAAATTACTATCGGATCGTTATCGGACTTGTCATCATCAACCTGGCCGG
GAGCCTCCAATCTGGACCGATGCTGATCCTTCAACTCCCTCAGCCTATGCAGCTGCAAAGATTGATATCGGAGATTTTAA
AGCCAAGGGTCTTTCTGGGACAATGAGATTTACTTTCTTGAGTGTTTTCGCGATACCAGCACTTTTGGATATCCTGCTAT
TAACAAGCACTGGCAAAGGTCTCTACTTGAGTGGAAATATGAGTCGCACAGCTCAGCATTCTGCTACGTTGGCTTTGATG
ATTTCCCTTTTAATATCAGGCATGTGTGGCACATGGATAACATGCGGCGGTTCTTACTATCTCATTTCAATGGCCTTTTC
CGCAATGAACCAATTCATAGCGACGAGAATCGTTGGCGGTGTTGCTTTCTCACTTGCCGCTGGCTTGATTGGCTTGATTG
GTCTTGGTATCAAAGATGGTATCGTTGCAGGGCTAGTATTCTTTTTGTACTTGTTTGCACTAAGCACCTATTTGATACTG
CTTGCAACTCTGGCCAATTTTTCTTATCCAGGTACCACTTTCCAATCTGGACGTCCAGTTATCCTCATGATTTTACCTGT
CTTATTTGTTTCACCAATCACAACAATTTTTGTTCCTGGTTATGATATCTATATCTATTTGAGTGTCTTGTATGTCTTTA
TATTTCTTCTCGCTTTGGGAACTCGACACACAGCATCTAAATGGACTACATGGCATCAAAATATTGAAAAGATTAGTGAC
AAGGAATTGAAAGAATGGTATATTAAGACTCACAAGGACGGCGATGACCGTGCATTCGATGGAATGACCGATCCGGCAGC
CTTGAAAATTTCAAGAACTGCAATGATTGAAGAAATAAGAAAAGTACGAAGTGGCTTTCGACATAACTGTCAGGATCCAA
CTGTCAAATCGTTGGTGGACAGCTATGACGCAACAATATTTCTATTGAAATGGTACTCGGGCTACTCGGGAACGCCACTA
CCAATGCCATATTCATCAACTTGGAACATGCAAATTAAGGTTGCTCTGGATACTCTCAAGCAAATGCAAACAGGTCTTAG

Fig. 110
GTTGCACAATGCTTTTATCCATTGGCGTCAGGCTGGTGATGAGGTGAGTAATTTTCTTTCACCATATAATTATTAAATTG
CGAAATGAAATACTAAAATAAGGCAGGTTGGTTGTAGTCTTCTCTACTTTATCGTAGCACTTCTCGACAAATGGAACTCA
CTTCTTGCCGGTGGACGTCTCCTCGGGCTATCGGCGCAGAATACAAGATACCGGATGCCTGTTGGCTTTGCTTTGGCTTA
TTACCTAATTGGTGCAGTTCTTCTAGATCTCAATGCCGCAAAGCTTCATACCATGACAGCTGAAAGTCAGAATATGCTGA
TTGGCGACGTCTCTTCAATTCCAGACGCAGTCGACGCAGGTGTCAAGGCACGGAGACACCTTTATTGGAGTATGCTGGGA
CGGTACTCATTATTTCATGTTTGGAGTTTAGCTGTAGCCTCTAGTCTTCTCTGGGTATTTGACAGCACAGAGGCTTCAAC
CCTTCTTTTTATTGCTTATGTTGGAGCCTATACAGGTAAGCACCATTTCCATGATTTGAAACGTTTGTTAATAAGTATCC
ACAGGTTTACTATTCTATCAGGTACATTTCCTTGTCAAGAACCTTGACAAAAATTTTTAAATCTACATCAGCTAAACTCT
CATCTAGTACACAAAAATTTTCGCGGGCCCTCGAAGTCTCAAGCCTCTTCTCATAGCCACTTGCGTTGGCCTTCCCTCTG
GACAAATACTTAGACATTTTCTTCCTCAATTCGAGTACTGTGATGTGGTAGCGCTTGCGGCAGCAACATGGACTGCAGCA
TTCCTCTCTCTATATTACGCGGGCATTAGAGCAAAACCAGTTGATACGATGGACTCCGAAGGTCGCATTTGGAATAAGAT
ATCACAAGATAGATCATTCCACGAATTCACAAGTCCGGGTCGTGAGTTATTACTATCTCAAGACGAGCTCCGCATGACTT
TCGAGAATCTGGATGCCCTTAACGATGACGAAAAATATGAAGTCGATCCTATGACACATCCCGGTTTGGAAATTAAGTCG
ATTCTACATCATGCTGTTGGAATATTTGAAGAGATCAAAGGCAGCTCGGTTGATTCAATCCCAAATTTTGCTCTGAGTGC
ATTTCCGGAAGTAAAGGCATTATTGGATGAGACCATCACAGCTTTTGAAAGTGGAAAGATTGTGGTCGAATGCGTCGCTA
TGTCTATGTTCTCTGATGAATTCAAGGACCTAAAAGCAATTGGCTGCGATTCCAGTAATCTAATGAGGATCATCATTGGT
TGCGAAACAATGGATGCGATGGACCAGAATTCAAGCATCAGTCTTTTCTGCCAGGCGTAAGTGACATTTCTCCTATTGCC
GCCACCAGTGTCAGATTCCTTACTGGAGTCATTCTATAGCCCGACCATTTTTAGTGCTAACCTGCTACAGGACTGCCGAA
ATACTGCTTCACATTGCAGCCGAAACTTTTCAGGGTGTTTCGCACGAAGACGCTATACTCCTGGAATCATTGCTCTCTTC
CGTTTCACCGTCAGGCCTATTGGAGCAAACCCTTGTACCTCAGGGACTACGAAACTTCTTGAATTTCTCAAACCCCTCAA
AAGCCGATGCAGAAAATGTTGCGACCTGTTTTGATGACGAAATCCTTAGACATACAGCTATCGGATGCAACCCAAACATT
GATTGGGAAGGACTTCCTACAGAGATTCGAGAGCTCATTCTCGACAGATGCACGGGACAAGTTGATGCATTGACAACTGA
CCAGCATAGTTGGGTACGAGCGAACAAGCTCAAAGGCCTACCCATCGCCACTTTCTTAGCTCGCCGCAATTTTGGTGCCT
TCGTTGCCACTGAAAAGAAACGGTACACATTGGAATTTGCGAAGACTGCTCCGGTAGAGAGTTCCGATAAGCATGAAAAG
TCTAACATAATGAACTTATTTGGAAAGACACAAACACGGAGATTGACAGCAGATTTAATCACAAAACAGCTGAAATGGCC
ATTCAGTAAGGTTTATCATACGATTGGGCATTGCCTGAAGTTATTCGCGATAGCATTTGTGGCAGAGCCAGAGTTGCAAA
GAGAGCTCAATTATACCATGAAGTCAACTCCAAAGTACATGCGATCGATTGTCATGTTCTTGATAACTGGAATATGGTCA
TACGCGAATTTTTTGCAGGGTATTTTGATGCCCATTTTCTTGCTCCATGGTAGAAAGAATGTAGAAACTCTCTGGAAACA
AATACGTGGTACGACAGTGTCATTAAAGCGTCAAAGGATAATGATAGACAGCACTGGAGGGTCTTCGACAGCATTTGTTC
GAGTCCCGGATACAGCCAGCATTACTGGTAGCCATATCATTAACAATGGTAGGGAAGGTGCTGAAGCCATACAAGAGTCG
TTACTCAGCAATGGCATCTGCGAGCTCCGACAATATGGTGGTGTCCTCAAGCAAGAGCCAGCCGATTCAGCCAAGCTTGA
GCGCATTAGCATTTACAGCAAGGATCTTCTTCTTTTACGCAGAGAAGACTATGTCAAAGGCGTGAAAGCAAACGTTTATG
AATATGAATACGACTTGGAAAAGATTTCAAAACAGAATGTCATGACAACACGTCGGCGCTATCCGATTTCGCGACGATGT
GTGGAAGGGAGTAACCAATTTGAACAAGTGTTGTTCAATAAACAAGGTCTTGTTCAAAGTGGGTCCTACATTCTCGATGG
AAATCTCGTGCGCTTCAATTGCCATTATAGACAAAACAGCAATTTTGAAGATGAGTTGTTGAGAGCAGAGTTTGTATTGC
CGCATATGTTTTGCATGGTTTCATGGGCCGCTCCTCCTGCTAAACGTCAAGACAAGCTGGACACATGGATACCCCATTCA
CAAGTTATCGAGGCCACCTTTGTCATCGGCCCCGATGTATATGAGTCACAGTGGTCATATGATCATAAATATCATCCAAC
CATATACACAACATTGAATGGCGAGCCTGTCGACACACCTGCGCTGATAGAATGGGATCATCTCGGAGTCCTCAAAAAGC
CCACCAACTTTGCATTTCGCCATGATGATCACATGATTGGCTTTAAATCATTACGCTCACATGCTTTGCCCAGATGGCTA
GGCATGAATACCCATCAAAATCCAGTCTCCACTTCGAAAGCTAGGTCGAGGCTATGGCAAGCATGGAAAAACAATTCGGC
GTATGATGTGTAATCATGAGATGGCTTGACGAAAGACTTCTTCGACGGGAACCAATGTTGCGCCCATATTATCGAAGAC
GTGATCACGGCAACCTCAGGCTGGCTGAAGAATATTTGCATGAGAATGCAGACGCAATTATGGCCGTTATCGATCTTGAT
AAATCAATTTCGGGATGGGCACCACTCGCATTTCAGATTGCAGATTTGTACGCATTTGGACAGGGGGGTTCTGCCAATGC
TCGCACGAGGTCTGCCCCAGATTTCAAAAGGCGACGAGCTTCATGTTCTTGCCACAGATCCGGAACTTGGCCCAATGAAG
GAGGTGGGGTGTCTGCATGTCGAAGAGACATGGTAAACAATCTTAAGGCAGCGAAATGGTACATGATTTCAGAATCAGCG
AATGACTTTGGAGTGCCTAAACATCAAACACAAGGAACGTCCAAACACTGAAAGTCATTCCAATTTGGGGACTCGATTT
CATGACACCGACCCATGGAATTTTCAGAGATCGATTAGATTCAGAGGTCATTCATGCTGTCAGAGATGCGACAAAATTAG
ACATTCAGAAGAATTTTGTTCCAATTCTCAAAGCTCTGGTGAAAGGGGCTAGAACGAGTCAATATTCGAACAGTGACATT
CTCCAATCAACCCGAGCTTTGGTCAACCTAAACGCGTATTTCTCCCAAGGAAAACATTGGACGGGTGTCTGGAACAGTAG
AATCGTTAAGAATGCCTGGCGGAACCTATGGATCTCACAAGACCTTGTGAGCCCAACTCCCTCAGAGGGTTGGTTTCAGA

Fig. 111
CTGAGATACCTACAATAGCTCAACTCGACGCCGCACTCGATCTCTGGTTTCGCTACTTGTTTATATTCTCTCTTCCCATG
CCTGAGAGGATTCCGGCGATTTTCCAAGCGTCACATCATTCCGTCAGTGCTTCGTATGGAATTGTGTGCAAGATTACTAG
GGGCAGCACATTGCAAATCTGGGATCACGCTATTAGTTGGCGCGAAACAAATCTCTACCTGTCTTCAGATCTTTGCTCTC
TACCACCATTTGTCAGAAACTCGTTACTTGGTCTCATGAAGCTCACCAGTCAACTGACACTTCACCACGCCGATATCATT
CTACCTTGCGCCGACTTCTTCAATCCTGGATGGGAAATCGAAATTGGATCACACCAAGGCAAACTCGAGCACCGAAACAT
TTTCAAGCGCAAGATTGATCCTGTCGTTAATGGTATCCCACCTGCAGATATCTCTAAATTCAGTCCAATCAAGGAGACAA
CTTCACCTTTGCCAACAGTCACCATGCTTTCTCATGTTTGGTATGCGAAGGATATCAAGACTGCCATTTTAGCTGCTGAT
ATCATTGTAAATGTATGGGGATTTAAAGACTATCGCCTCGATATCTACGGTGCAATTGACAAAGCACCACAATACTCAAC
AGACTGTTTCGAAATATTAGCCTCCAAATCCTTACCAGGCTATGTCAACTTGTGCGGAACTGCAAGCCCAACTGATGTGC
TCAAGAAAACTTGGGTCTTCCTTAATTCTTCTATCTCCGAGGGGCTTCCCTTAGCATTGGGCGAAGCAGCTTTGACTGGC
GCGCCTGTTGTATGTACAGATGTTGGGGCTTCCCTTCGGGTTCTTACAGATTTCAACACCGGCGACTGCTTCAGTGCTGT
GGTTGCCCCCAATGATGCACAAAGTCTTGCAAGAGCGCAGATCAATATGCTTGGTCTTTTGGACGAATGGGCTCCTTATG
CGAATGACCCTCAAGGTTACAAGCCTCCTTCTATCATCGATAAGCCTTCTGCAGAAGAAGTTGCGATTATTACCAAGAGA
ATGTATGAGAAGAAAGGCGAACTTCGAGCCCTTGGAATGCGAAGTCGAGAAATTGTTCAAAAATCTTTCGGAGGCAACAG
GTATCTCAGAGAGCATGAGCAGATGCTCTGGATTGGAAAGTCTCGCTACGACATAAAATTCCCTTCAAAACAACCAAGAC
CCACATTAAGACCTGCACTACCATCACTCGCAGTAGCAAGTAACATGTGGGGACAAGCATCTATACCCTCTGCTATCCAG
ACTCGACCTATGCGACCATCCATCTTCCGGGGATCCAGTCCTAGCATAATGGCACGATCCATGCAAGCAGCTTCAACCGT
TGTTCCATCCCCCACTCTCGAAAGACCTACTTCCATCATGGGTTACGGCAGTGGTGTCAAGGGTTATCAAAATATCAACG
ATTACTTCGCCGGCTACCGACCTGGCGATAGTAACGCCTCTACTCCCGATCTCCAATTCCTCACGCCTCCTGGTATCCAC
ACGCCCGGTGGTAATTCTGTTAGAAGCCAGTCACCGATGAGGAAAGGGGCATCTACACGTCTTACGATGCTCTCTAGAGG
CAGCACTAGTTACGATACTAGATCTGAGAGTTCCTCATTAATCGTACCCTCTAAACGATTACCTGGAGAGGATTCATTCC
TTCGTGATCTGGACACCGCTCTTGGACGCGTGTAA

Fig. 112
Aspergillus oryzae
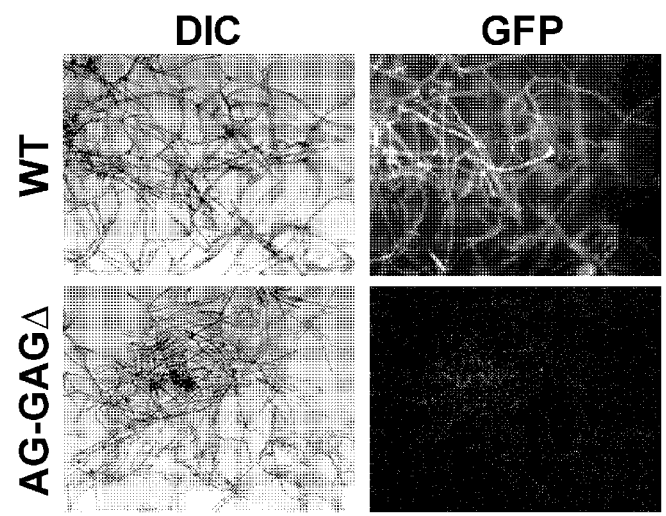
Botrytis cinerea
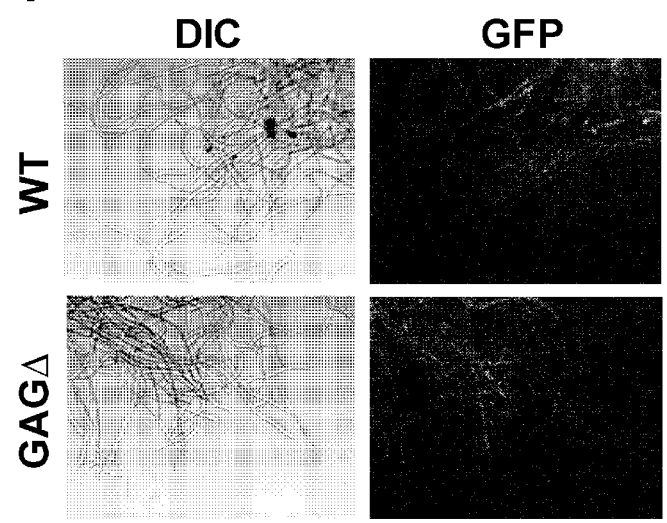

Cochliobolus heterostrophus

MUTANT FILAMENTOUS FUNGUS AND SUBSTANCE PRODUCTION METHOD IN WHICH SAID MUTANT FILAMENTOUS FUNGUS IS USED

TECHNICAL FIELD

The present invention relates to a mutant filamentous fungus and a method of producing a substance using the mutant filamentous fungus.

BACKGROUND ART

A filamentous fungus is a collective name for fungi constructed of tubular cells called hyphae, and is used for fermentative production of: low-molecular-weight compounds, for example, chemical products such as an organic acid, a pigment, and an agricultural chemical bulk, and pharmaceutical products such as penicillin and statins; and industrial enzymes such as amylase, cellulase, protease, and lipase.

For example, in Patent Literature 1, there is a description of a method of producing cellulase, including the steps of: producing a disaccharide-containing solution by adding thermophilic fungus-derived β-glucosidase to a glucose-containing solution and subjecting the mixture to a condensation reaction; and producing cellulase by culturing a filamentous fungus using a medium containing the disaccharide-containing solution.

In addition, in Patent Literature 2, there is a description of a method of producing phospholipase, including a step of processing a fungal peptide to truncate a peptide from the C-terminus and/or a peptide from the N-terminus, to thereby produce a core peptide formed of a specific amino acid sequence having phospholipase activity.

In addition, in Patent Literatures 3 to 7, with a view to increasing efficiency of substance production using the filamentous fungus, there is a description of an expression vector constructed so that the filamentous fungus functions as a host, there is also a description of a method involving preparing a transformant by introducing, into the filamentous fungus, a plasmid in which a gene encoding a homologous or heterologous protein is functionally linked to the expression vector, and there is also a description that utilization of the transformant contributes to increased production of enzymes such as amylase and cellulase and low-molecular-weight compounds such as penicillin.

As described above, the filamentous fungus has an advantage of being able to produce a wide variety of useful substances. However, the filamentous fungus causes a problem in that the filamentous fungus cannot be cultured at a high density because of entanglement of hyphae and aggregation of cells in its liquid culture step, a problem in that a production amount of a useful substance lowers, and a problem in that a production step of a useful substance becomes complicated (e.g., Patent Literatures 8 and 9).

Under such circumstances, the inventors of the present invention have found that, when a mutant filamentous fungus lacking expression of α-1,3-glucan is used, aggregation of cells during culture is suppressed more than in the related art and the cells are relatively homogeneously dispersed in a medium, and thus have developed a method of producing a substance (Patent Literature 10). However, although the use of the mutant filamentous fungus suppresses the aggregation of the cells more than in the related art, there is a demand for development of a filamentous fungus that is still less liable to form an aggregate.

CITATION LIST

Patent Literature

PTL 1: JP 2010-227032 A
PTL 2: JP 2010-172343 A
PTL 3: JP 2001-46078 A
PTL 4: JP 2005-52116 A
PTL 5: JP 2009-118783 A
PTL 6: JP 11-506025 A
PTL 7: JP 2007-508022 A
PTL 8: JP 2002-218970 A
PTL 9: JP 2010-227031 A
PTL 10: WO 2014/073674 A1 Non-patent Literature
NPL 1: Fontaine T. et al. (2011) Galactosaminogalactan, a New Immunosupressive Polysacharide of *Aspergillus fumigatus*, PLoS Pathogens, 7: e1002372
NPL 2: Rappleye C. A. et al. (2004) RNA interference in *Histoplasma capsulatum* demonstrates a role for α-(1,3)-glucan in virulence. Mol. Microbiol. 53: 153-165.
NPL 3: Beauvais A. et al. (2005) Two α(1-3) Glucan Synthases with Different Functions in *Aspergillus fumigatus*. Appl. Environ. Microbiol. 71: 1531-1538.
NPL 4: Maubon D. et al. (2006) AGS3, an α(1-3)glucan synthase gene family member of *Aspergillus fumigatus*, modulates mycelium growth in the lung of experimentally infected mice. Fungal Genet. Biol. 43: 366-375.
NPL 5: Henry C. et al. (2011) α1,3 glucans are dispensable in *Aspergillus fumigatus*. Eukaryot. Cell 11: 26-29
NPL 6: Mizutani O. et al. (2008) A defect of LigD (human Lig4 homolog) for nonhomologous end joining significantly improves efficiency of gene-targeting in *Aspergillus oryzae*. Fung. Genet. Biol., 45: 878-889.
NPL 7: Zhang S. et al. (2017) Self-excising Cre/mutant lox marker recycling system for multiple gene integrations and consecutive gene deletion in *Aspergillus oryzae*. J. Biosci. Bioengin. 123: 403-411
NPL 8: Gomi K. et al. (1987) Integrative transformation of *Aspergillus oryzae* with a plasmid containing the *Aspergillus nidulans* argB gene. Agric. Biol. Chem. 51: 2549-2555
NPL 9: Natalie et al (2015) Sph3 Is a Glycoside Hydrolase Required for the Biosynthesis of Galactosaminogalactan in *Aspergillus fumigatus*. J Biol Chem 290, 27438

SUMMARY OF INVENTION

Technical Problem

An object of the present invention is to provide a filamentous fungus mutant strain that is still more suppressed in aggregation of cells (hyphae) in a medium than a related-art filamentous fungus.

Solution to Problem

Under such circumstances, the inventors of the present invention have made extensive investigations on a wide variety of factors in filamentous fungi from the viewpoint of the aggregation of cells, and as a result, have found a galactosaminogalactan (GAG) biosynthetic cluster to be a novel factor. In Non-patent Literature 9, a disruption strain of the GAG biosynthetic cluster is obtained using *Aspergillus fumigatus*, and is analyzed for evaluating the effect of the cluster disruption. In Non-patent Literature 9, it is reported that GAG is not observed on the cell wall surface of the disruption strain, but that there is no difference in germination or growth between the disruption strain and a wild-type strain. The inventors of the present invention have caused a filamentous fungus modified so as not to express α-1,3-glucan or a filamentous fungus originally lacking α-1,3-glucan synthase gene ags to be deficient in function of the GAG biosynthetic cluster of the filamentous fungus, and as a result, have observed a further decrease in expression of galactosaminogalactan, and besides, have surprisingly found that the aggregation of cells is suppressed and the cells are completely dispersed. The present invention is based on such novel findings.

Advantageous Effects of Invention

According to the present invention, the filamentous fungus mutant strain that is still more suppressed in aggregation of cells in a medium than the related-art filamentous fungus can be provided. When cells aggregate during culture, the inside of the aggregate becomes anaerobic to kill the cells. Therefore, the filamentous fungus of the present invention suppressed in aggregation and the method using the same contribute to efficient culture and substance production of the filamentous fungus, and hence are extremely useful.

BRIEF DESCRIPTION OF DRAWINGS

FIG. 1 Estimation of GAG biosynthetic gene cluster in *A. oryzae* (A) A GAG biosynthetic gene cluster in *A. oryzae* was predicted on the basis of the sequences of a GAG biosynthetic gene cluster in *A. fumigatus*. (B) The results of sequence alignment with ClustalW of sph3 in *A. fumigatus*, *A. clavatus*, *A. oryzae*, *Marssonia brunnea*, *Ralstonia picketti*, and *Physarum polycephalum*. Also in predicted sph3 of *A. oryzae*, there was a highly conserved region.

FIG. 2 Production of uge3/sph3 gene disruption cassette, strain deficient only in GAG, and AG-GAG-deficient strain (A) A uge3 downstream (5' side) region (amplicon 1) and an sph3 downstream (3' side) region (amplicon 2) were amplified by PCR using genomic DNA of *A. oryzae* as a template. In addition, AnadeA gene (amplicon 3) was amplified from a plasmid TOPO-2.1-adeA by PCR (1st round of PCR). PCR was performed again from both sides of amplicons 1 and 2 to link the three fragments (2nd round of PCR). A main band of the PCR product was gel-extracted, and used as a uge3/sph3 gene disruption cassette. Next, an AG-deficient strain was used as a parental strain and transformed with the uge3/sph3 gene disruption cassette. Selection was performed with adeA-free CD agar plate medium to acquire a strain deficient only in GAG and an AG-GAG-deficient strain. (B) The acquired AG-GAG-deficient strain was confirmed by PCR amplification to have the construct introduced therein.

FIG. 3 Comparison of culture properties of wild-type strain, AG-deficient strain, AG-GAG-deficient strain, and GAG-deficient strain. A wild-type strain, the AG-deficient strain, the AG-GAG-deficient strain, and a GAG-deficient strain were used and subjected to liquid shaking culture in YPD medium for 24 hours. (A) Photographs of flasks are shown in an upper row, cells observed after transfer to 6 cm dishes are shown in a middle row, and stereoscopic micrographs are shown in a lower row. In all cases, observation was performed at 24 hours of culture. (B) Microscopic observation was performed at 10 hours of culture. The length of a bar in each figure is as follows: left of FIG. 3(B): 200 µm, center of FIG. 3(B): 200 µm, right of FIG. 3(B): 100 µm. (C) $1.0 \times 10^3$ conidia were inoculated at the center of agar medium, and subjected to static culture at 30° C. for 5 days.

FIG. 4 Production of strain highly expressing cutL1 for AG-GAG-deficient strain (production of AG-GAG-deficient strain highly expressing cutL1) (A) A method of producing an AG-GAG-deficient strain highly expressing cutL1 is illustrated. Arrows indicate primer positions for construct introduction confirmation. (B) The results of construct introduction confirmation by PCR amplification. (C) A halo formation test was performed by inoculating conidia at the center of CD medium containing 1% PBSA and performing static culture at 30° C. for 4 days.

FIG. 5 Evaluation of CutL1 productivity in AG-GAG-deficient strain (A) Dry cell weights in the case of culturing the wild-type strain, the AG-deficient strain, and the AG-GAG-deficient strain (each of which is a strain highly expressing cutL1) in YPM medium (24 hours, 100 rpm, and $1 \times 10^4$ conidia inoculated). (B) CutL1 secretion amounts in the wild-type strain, the AG-deficient strain, and the AG-GAG-deficient strain (each of which is a strain highly expressing cutL1). Culture conditions were the same as above, i.e., YPM medium, 24 hours, 100 rpm, and $1 \times 10^4$ conidia inoculated.

FIG. 6 The putative amino acid sequence of AgsA of *Aspergillus oryzae* (SEQ ID NO: 1) is shown.

FIG. 7 The base sequence of a nucleic acid molecule encoding AgsA of *Aspergillus oryzae* (SEQ ID NO: 2) is shown.

FIG. 8 The base sequence of a nucleic acid molecule encoding AgsA of *Aspergillus oryzae* (SEQ ID NO: 2) is shown.

FIG. 9 The putative amino acid sequence of AgsB of *Aspergillus oryzae* (SEQ ID NO: 3) is shown in FIG. 9.

FIG. 10 The base sequence of a nucleic acid molecule encoding AgsB of *Aspergillus oryzae* (SEQ ID NO: 4) is shown.

FIG. 11 The base sequence of a nucleic acid molecule encoding AgsB of *Aspergillus oryzae* (SEQ ID NO: 4) is shown.

FIG. 12 The putative amino acid sequence of AgsC of *Aspergillus oryzae* (SEQ ID NO: 5) is shown.

FIG. 13 The base sequence of a nucleic acid molecule encoding AgsC of *Aspergillus oryzae* (SEQ ID NO: 6) is shown.

FIG. 14 The base sequence of a nucleic acid molecule encoding AgsC of *Aspergillus oryzae* (SEQ ID NO: 6) is shown.

FIG. 15 The putative amino acid sequence of AgsA of *Aspergillus nidulans* (SEQ ID NO: 7) is shown.

FIG. 16 The base sequence of a nucleic acid molecule encoding AgsA of *Aspergillus nidulans* (SEQ ID NO: 8) is shown.

FIG. 17 The base sequence of a nucleic acid molecule encoding AgsA of *Aspergillus nidulans* (SEQ ID NO: 8) is shown.

FIG. 18 The putative amino acid sequence of AgsB of *Aspergillus nidulans* (SEQ ID NO: 9) is shown.

FIG. 19 The base sequence of a nucleic acid molecule encoding AgsB of *Aspergillus nidulans* (SEQ ID NO: 10) is shown.

FIG. 20 The base sequence of a nucleic acid molecule encoding AgsB of *Aspergillus nidulans* (SEQ ID NO: 10) is shown.

FIG. 21 The putative amino acid sequence of AgsA of *Aspergillus sojae* (SEQ ID NO: 11) is shown.

FIG. 22 The base sequence of a nucleic acid molecule encoding AgsA of *Aspergillus sojae* (SEQ ID NO: 12) is shown.

FIG. 23 The base sequence of a nucleic acid molecule encoding AgsA of *Aspergillus sojae* (SEQ ID NO: 12) is shown.

FIG. 24 The putative amino acid sequence of AgsB of *Aspergillus sojae* (SEQ ID NO: 13) is shown.

FIG. 25 The base sequence of a nucleic acid molecule encoding AgsB of *Aspergillus sojae* (SEQ ID NO: 14) is shown.

FIG. 26 The base sequence of a nucleic acid molecule encoding AgsB of *Aspergillus sojae* (SEQ ID NO: 14) is shown.

FIG. 27 The putative amino acid sequence of AgsC of *Aspergillus sojae* (SEQ ID NO: 15) is shown.

FIG. 28 The base sequence of a nucleic acid molecule encoding AgsC of *Aspergillus sojae* (SEQ ID NO: 16) is shown.

FIG. 29 The base sequence of a nucleic acid molecule encoding AgsC of *Aspergillus sojae* (SEQ ID NO: 16) is shown.

FIG. 30 The putative amino acid sequence of AgsE of *Aspergillus niger* (SEQ ID NO: 17) is shown.

FIG. 31 The base sequence of a nucleic acid molecule encoding AgsE of *Aspergillus niger* (SEQ ID NO: 18) is shown.

FIG. 32 The base sequence of a nucleic acid molecule encoding AgsE of *Aspergillus niger* (SEQ ID NO: 18) is shown.

FIG. 33 The putative amino acid sequence of Agsl of *Aspergillus fumigatus* (SEQ ID NO: 19) is shown.

FIG. 34 The base sequence of a nucleic acid molecule encoding Agsl of *Aspergillus fumigatus* (SEQ ID NO: 20) is shown.

FIG. 35 The base sequence of a nucleic acid molecule encoding Agsl of *Aspergillus fumigatus* (SEQ ID NO: 20) is shown.

FIG. 36 The putative amino acid sequence of Uge3 of *Aspergillus oryzae* (SEQ ID NO: 21) and the base sequence of a nucleic acid molecule encoding Uge3 thereof (SEQ ID NO: 22) are shown.

FIG. 37 The putative amino acid sequence of Sph3 of *Aspergillus oryzae* (SEQ ID NO: 23) and the base sequence of a nucleic acid molecule encoding Sph3 thereof (SEQ ID NO: 24) are shown.

FIG. 38 The putative amino acid sequence of Ega3 of *Aspergillus oryzae* (SEQ ID NO: 25) and the base sequence of a nucleic acid molecule encoding Ega3 thereof (SEQ ID NO: 26) are shown.

FIG. 39 The putative amino acid sequence of Agd3 of *Aspergillus oryzae* (SEQ ID NO: 27) and the base sequence of a nucleic acid molecule encoding Agd3 thereof (SEQ ID NO: 28) are shown.

FIG. 40 The putative amino acid sequence of Gtb3 of *Aspergillus oryzae* (SEQ ID NO: 29) is shown.

FIG. 41 The base sequence of a nucleic acid molecule encoding Gtb3 of *Aspergillus oryzae* (SEQ ID NO: 30) is shown.

FIG. 42 The base sequence of a nucleic acid molecule encoding Gtb3 of *Aspergillus oryzae* (SEQ ID NO: 30) is shown.

FIG. 43 The base sequence of a nucleic acid molecule encoding Gtb3 of *Aspergillus oryzae* (SEQ ID NO: 30) is shown.

FIG. 44 The putative amino acid sequence of Uge3 of *Aspergillus nidulans* (SEQ ID NO: 31) and the base sequence of a nucleic acid molecule encoding Uge3 thereof (SEQ ID NO: 32) are shown.

FIG. 45 The putative amino acid sequence of Sph3 of *Aspergillus nidulans* (SEQ ID NO: 33) and the base sequence of a nucleic acid molecule encoding Sph3 thereof (SEQ ID NO: 34) are shown.

FIG. 46 The putative amino acid sequence of Ega3 of *Aspergillus nidulans* (SEQ ID NO: 35) and the base sequence of a nucleic acid molecule encoding Ega3 thereof (SEQ ID NO: 36) are shown.

FIG. 47 The putative amino acid sequence of Agd3 of *Aspergillus nidulans* (SEQ ID NO: 37) and the base sequence of a nucleic acid molecule encoding Agd3 thereof (SEQ ID NO: 38) are shown.

FIG. 48 The putative amino acid sequence of Gtb3 of *Aspergillus nidulans* (SEQ ID NO: 39) is shown.

FIG. 49 The base sequence of a nucleic acid molecule encoding Gtb3 of *Aspergillus nidulans* (SEQ ID NO: 40) is shown.

FIG. 50 The base sequence of a nucleic acid molecule encoding Gtb3 of *Aspergillus nidulans* (SEQ ID NO: 40) is shown.

FIG. 51 The base sequence of a nucleic acid molecule encoding Gtb3 of *Aspergillus nidulans* (SEQ ID NO: 40) is shown.

FIG. 52 The putative amino acid sequence of Uge3 of *Aspergillus sojae* (SEQ ID NO: 41) and the base sequence of a nucleic acid molecule encoding Uge3 thereof (SEQ ID NO: 42) are shown.

FIG. 53 The putative amino acid sequence of Sph3 of *Aspergillus sojae* (SEQ ID NO: 43) and the base sequence of a nucleic acid molecule encoding Sph3 thereof (SEQ ID NO: 44) are shown.

FIG. 54 The putative amino acid sequence of Ega3 of *Aspergillus sojae* (SEQ ID NO: 45) and the base sequence of a nucleic acid molecule encoding Ega3 thereof (SEQ ID NO: 46) are shown.

FIG. 55 The putative amino acid sequence of Agd3 of *Aspergillus sojae* (SEQ ID NO: 47) and the base sequence of a nucleic acid molecule encoding Agd3 thereof (SEQ ID NO: 48) are shown.

FIG. 56 The putative amino acid sequence of Gtb3 of *Aspergillus sojae* (SEQ ID NO: 49) is shown.

FIG. 57 The base sequence of a nucleic acid molecule encoding Gtb3 of *Aspergillus sojae* (SEQ ID NO: 50) is shown.

FIG. 58 The base sequence of a nucleic acid molecule encoding Gtb3 of *Aspergillus sojae* (SEQ ID NO: 50) is shown.

FIG. 59 The base sequence of a nucleic acid molecule encoding Gtb3 of *Aspergillus sojae* (SEQ ID NO: 50) is shown.

FIG. 60 The putative amino acid sequence of Uge3 of *Aspergillus niger* (SEQ ID NO: 51) and the base sequence of a nucleic acid molecule encoding Uge3 thereof (SEQ ID NO: 52) are shown.

FIG. 61 The putative amino acid sequence of Sph3 of *Aspergillus niger* (SEQ ID NO: 53) and the base sequence of a nucleic acid molecule encoding Sph3 thereof (SEQ ID NO: 54) are shown.

FIG. 62 The putative amino acid sequence of Ega3 of *Aspergillus niger* (SEQ ID NO: 55) and the base sequence of a nucleic acid molecule encoding Ega3 thereof (SEQ ID NO: 56) are shown.

FIG. 63 The putative amino acid sequence of Agd3 of *Aspergillus niger* (SEQ ID NO: 57) and the base sequence of a nucleic acid molecule encoding Agd3 thereof (SEQ ID NO: 58) are shown.

FIG. 64 The putative amino acid sequence of Gtb3 of *Aspergillus niger* (SEQ ID NO: 59) is shown.

FIG. 65 The base sequence of a nucleic acid molecule encoding Gtb3 of *Aspergillus niger* (SEQ ID NO: 60) is shown.

FIG. 66 The base sequence of a nucleic acid molecule encoding Gtb3 of *Aspergillus niger* (SEQ ID NO: 60) is shown.

FIG. 67 The base sequence of a nucleic acid molecule encoding Gtb3 of *Aspergillus niger* (SEQ ID NO: 60) is shown.

FIG. 68 The putative amino acid sequence of Uge3 of *Aspergillus fumigatus* (SEQ ID NO: 61) and the base sequence of a nucleic acid molecule encoding Uge3 thereof (SEQ ID NO: 62) are shown.

FIG. 69 The putative amino acid sequence of Sph3 of *Aspergillus fumigatus* (SEQ ID NO: 63) and the base sequence of a nucleic acid molecule encoding Sph3 thereof (SEQ ID NO: 64) are shown.

FIG. 70 The putative amino acid sequence of Ega3 of *Aspergillus fumigatus* (SEQ ID NO: 65) and the base sequence of a nucleic acid molecule encoding Ega3 thereof (SEQ ID NO: 66) are shown.

FIG. 71 The putative amino acid sequence of Agd3 of *Aspergillus fumigatus* (SEQ ID NO: 67) and the base sequence of a nucleic acid molecule encoding Agd3 thereof (SEQ ID NO: 68) are shown.

FIG. 72 The putative amino acid sequence of Gtb3 of *Aspergillus fumigatus* (SEQ ID NO: 69) is shown.

FIG. 73 The base sequence of a nucleic acid molecule encoding Gtb3 of *Aspergillus fumigatus* (SEQ ID NO: 70) is shown.

FIG. 74 The base sequence of a nucleic acid molecule encoding Gtb3 of *Aspergillus fumigatus* (SEQ ID NO: 70) is shown.

FIG. 75 The base sequence of a nucleic acid molecule encoding Gtb3 of *Aspergillus fumigatus* (SEQ ID NO: 70) is shown.

FIG. 76 The putative amino acid sequence of AgsB of *Penicillium chrysogenum* (SEQ ID NO: 71) is shown.

FIG. 77 The base sequence of a nucleic acid molecule encoding AgsB of *Penicillium chrysogenum* (SEQ ID NO: 72) is shown.

FIG. 78 The base sequence of a nucleic acid molecule encoding AgsB of *Penicillium chrysogenum* (SEQ ID NO: 72) is shown.

FIG. 79 The putative amino acid sequence of Uge3 of *Penicillium chrysogenum* (SEQ ID NO: 73) and the base sequence of a nucleic acid molecule encoding Uge3 thereof (SEQ ID NO: 74) are shown.

FIG. 80 The putative amino acid sequence of Sph3 of *Penicillium chrysogenum* (SEQ ID NO: 75) and the base sequence of a nucleic acid molecule encoding Sph3 thereof (SEQ ID NO: 76) are shown.

FIG. 81 The putative amino acid sequence of Ega3 of *Penicillium chrysogenum* (SEQ ID NO: 77) and the base sequence of a nucleic acid molecule encoding Ega3 thereof (SEQ ID NO: 78) are shown.

FIG. 82 The putative amino acid sequence of Agd3 of *Penicillium chrysogenum* (SEQ ID NO: 79) is shown.

FIG. 83 The base sequence of a nucleic acid molecule encoding Agd3 of *Penicillium chrysogenum* (SEQ ID NO: 80) is shown.

FIG. 84 The putative amino acid sequence of Gtb3 of *Penicillium chrysogenum* (SEQ ID NO: 81) is shown.

FIG. 85 The base sequence of a nucleic acid molecule encoding Gtb3 of *Penicillium chrysogenum* (SEQ ID NO: 82) is shown.

FIG. 86 The base sequence of a nucleic acid molecule encoding Gtb3 of *Penicillium chrysogenum* (SEQ ID NO: 82) is shown.

FIG. 87 The base sequence of a nucleic acid molecule encoding Gtb3 of *Penicillium chrysogenum* (SEQ ID NO: 82) is shown.

FIG. 91 (A) A GAG biosynthetic gene cluster in *Cochliobolus heterostrophus* is illustrated and (B) electrophoresis results of PCR products of genomic DNAs extracted from gene disruption strain candidates are shown.

FIG. 92 Culture properties of a wild-type strain and GAGA strain of *Cochliobolus heterostrophus* are shown.

FIG. 93 (A) A GAG biosynthetic gene cluster in *B. fuckeliana* is illustrated and (B) electrophoresis results of PCR products of genomic DNAs extracted from gene disruption strain candidates are shown.

FIG. 94 Culture properties of a wild-type strain and GAGA strain of *B. fuckeliana* are shown.

FIG. 95 The putative amino acid sequence of uge3 of *Cochliobolus heterostrophus* (anamorph: *Bipolaris maydis*) (SEQ ID NO: 89), the base sequence of a nucleic acid molecule of uge3 thereof (SEQ ID NO: 90), the putative amino acid sequence of sph3 thereof (SEQ ID NO: 91), and the base sequence of a nucleic acid molecule of sph3 thereof (SEQ ID NO: 92) are shown in FIG. 95.

FIG. 96 The putative amino acid sequence of ega3 of *Cochliobolus heterostrophus* (anamorph: *Bipolaris maydis*) (SEQ ID NO: 93), the base sequence of a nucleic acid molecule of ega3 thereof (SEQ ID NO: 94), the putative amino acid sequence of agd3 thereof (SEQ ID NO: 95), and the base sequence of a nucleic acid molecule of agd3 thereof (SEQ ID NO: 96) are shown in FIG. 96 and FIG. 97.

FIG. 97 The putative amino acid sequence of ega3 of *Cochliobolus heterostrophus* (anamorph: *Bipolaris maydis*) (SEQ ID NO: 93), the base sequence of a nucleic acid molecule of ega3 thereof (SEQ ID NO: 94), the putative amino acid sequence of agd3 thereof (SEQ ID NO: 95), and the base sequence of a nucleic acid molecule of agd3 thereof (SEQ ID NO: 96) are shown in FIG. 96 and FIG. 97.

FIG. 98 The putative amino acid sequence of gtb3 of *Cochliobolus heterostrophus* (anamorph: *Bipolaris maydis*) (SEQ ID NO: 97) and the base sequence of a nucleic acid molecule of gtb3 thereof (SEQ ID NO: 98) are shown in FIG. 98 to FIG. 101.

FIG. 99 The putative amino acid sequence of gtb3 of *Cochliobolus heterostrophus* (anamorph: *Bipolaris maydis*) (SEQ ID NO: 97) and the base sequence of a nucleic acid molecule of gtb3 thereof (SEQ ID NO: 98) are shown in FIG. 98 to FIG. 101.

FIG. 100 The putative amino acid sequence of gtb3 of *Cochliobolus heterostrophus* (anamorph: *Bipolaris maydis*)

(SEQ ID NO: 97) and the base sequence of a nucleic acid molecule of gtb3 thereof (SEQ ID NO: 98) are shown in FIG. 98 to FIG. 101.

FIG. 101 The putative amino acid sequence of gtb3 of *Cochliobolus heterostrophus* (anamorph: *Bipolaris maydis*) (SEQ ID NO: 97) and the base sequence of a nucleic acid molecule of gtb3 thereof (SEQ ID NO: 98) are shown in FIG. 98 to FIG. 101.

FIG. 102 The putative amino acid sequence of ags1 of *Botrytis cinerea* (SEQ ID NO: 99) and the base sequence of a nucleic acid molecule of ags1 thereof (SEQ ID NO: 100) are shown in FIG. 102 to FIG. 104.

FIG. 103 The putative amino acid sequence of ags1 of *Botrytis cinerea* (SEQ ID NO: 99) and the base sequence of a nucleic acid molecule of ags1 thereof (SEQ ID NO: 100) are shown in FIG. 102 to FIG. 104.

FIG. 104 The putative amino acid sequence of ags1 of *Botrytis cinerea* (SEQ ID NO: 99) and the base sequence of a nucleic acid molecule of ags1 thereof (SEQ ID NO: 100) are shown in FIG. 102 to FIG. 104.

FIG. 105 The putative amino acid sequence of uge3 of *Botrytis cinerea* (SEQ ID NO: 101), the base sequence of a nucleic acid molecule of uge3 thereof (SEQ ID NO: 102), the putative amino acid sequence of sph3 thereof (SEQ ID NO: 103), and the base sequence of a nucleic acid molecule of sph3 thereof (SEQ ID NO: 104) are shown in FIG. 105.

FIG. 106 The putative amino acid sequence of ega3 of *Botrytis cinerea* (SEQ ID NO: 105), the base sequence of a nucleic acid molecule of ega3 thereof (SEQ ID NO: 106), the putative amino acid sequence of agd3 thereof (SEQ ID NO: 107), and the base sequence of a nucleic acid molecule of agd3 thereof (SEQ ID NO: 108) are shown in FIG. 106 and FIG. 107.

FIG. 107 The putative amino acid sequence of ega3 of *Botrytis cinerea* (SEQ ID NO: 105), the base sequence of a nucleic acid molecule of ega3 thereof (SEQ ID NO: 106), the putative amino acid sequence of agd3 thereof (SEQ ID NO: 107), and the base sequence of a nucleic acid molecule of agd3 thereof (SEQ ID NO: 108) are shown in FIG. 106 and FIG. 107.

FIG. 108 The base sequence of a nucleic acid molecule of gtb3 of *Botrytis cinerea* (SEQ ID NO: 109) and the base sequence of a nucleic acid molecule of gtb3 thereof (SEQ ID NO: 110) are shown in FIG. 108 to FIG. 111.

FIG. 109 The base sequence of a nucleic acid molecule of gtb3 of *Botrytis cinerea* (SEQ ID NO: 109) and the base sequence of a nucleic acid molecule of gtb3 thereof (SEQ ID NO: 110) are shown in FIG. 108 to FIG. 111.

FIG. 110 The base sequence of a nucleic acid molecule of gtb3 of *Botrytis cinerea* (SEQ ID NO: 109) and the base sequence of a nucleic acid molecule of gtb3 thereof (SEQ ID NO: 110) are shown in FIG. 108 to FIG. 111.

FIG. 111 The base sequence of a nucleic acid molecule of gtb3 of *Botrytis cinerea* (SEQ ID NO: 109) and the base sequence of a nucleic acid molecule of gtb3 thereof (SEQ ID NO: 110) are shown in FIG. 108 to FIG. 111.

FIG. 112 The results of staining with AGBD-GFP for various cells are shown.

Figure 113:
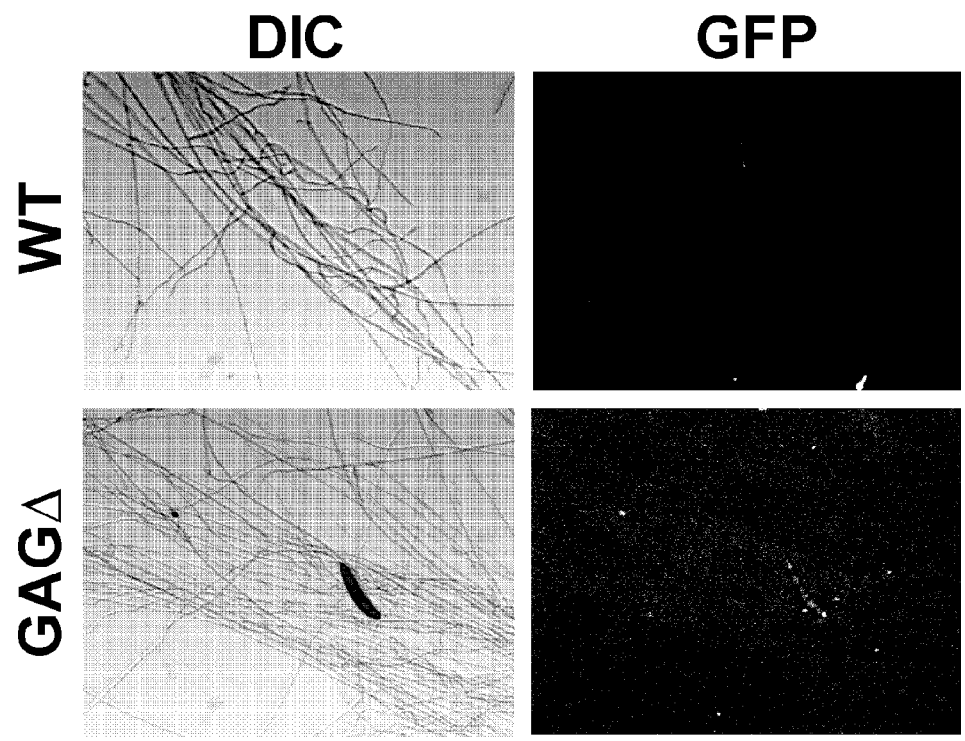

FIG. 113 The results of staining with AGBD-GFP for various cells are shown.

DESCRIPTION OF EMBODIMENTS

The present invention provides a mutant filamentous fungus which lacks expression of α-1,3-glucan, and is deficient in at least part of a GAG biosynthetic cluster.

Mutant Strain of Filamentous Fungus

In the present invention, the term "mutant filamentous fungus lacking expression of α-1,3-glucan" encompasses not only a filamentous fungus mutant strain completely lacking expression of α-1,3-glucan but also a filamentous fungus mutant strain substantially lacking expression of α-1,3-glucan. More specifically, the mutant strain substantially lacking expression of α-1,3-glucan refers to a mutant strain that expresses only a small amount of α-1,3-glucan and shows significant suppression of aggregation of cells, which is the effect of the present invention, and an example thereof is a strain having an expression amount of α-1,3-glucan of 30% or less with respect to that of a wild-type strain, more preferably 10% or less with respect to that of the wild-type strain. In addition, the filamentous fungus mutant strain in the present invention also encompasses a mutant strain obtained by causing a filamentous fungus originally lacking expression of α-1,3-glucan to be deficient in function of the GAG biosynthetic cluster.

Examples of the filamentous fungus include the genus *Aspergillus*, the genus *Penicillium* (e.g., *Penicillium chrysogenum*), the genus *Trichoderma*, the genus *Cephalosporium*, the genus *Acremonium*, the genus *Neurospora*, the genus *Botrytis*, the genus *Cochliobolus*, and the genus *Monascus*. Of those, the genus *Aspergillus*, the genus *Botrytis*, or the genus *Cochliobolus* is preferred, and the genus *Aspergillus* is more preferred. Examples of the filamentous fungi of the genus *Aspergillus* to be used in the present invention include *Aspergillus oryzae*, *Aspergillus sojae*, *Aspergillus nidulans*/*Emericella nidulans*, *Aspergillus niger*, and *Aspergillus fumigatus*. Of those, *Aspergillus oryzae*, *Aspergillus sojae*, *Aspergillus nidulans*, or *Aspergillus niger* is preferred, *Aspergillus oryzae* or *Aspergillus sojae* is more preferred, and *Aspergillus oryzae* is still more preferred. Examples of the filamentous fungi of the genus *Botrytis* to be used in the present invention include *Botrytis cinerea* (teleomorph: *Botryotinia fuckeliana*), *Botrytis Botrytis squamosa*, and *Botrytis byssoidea*. Examples of the filamentous fungi of the genus *Cochliobolus* to be used in the present invention include *Cochliobolus heterostrophus* (anamorph: *Bipolaris maydis*), *Cochliobolus carbonum*, *Cochliobolus miyabeanus*, and *Cochliobolus victoriae*. Examples of the genus *Monascus* include *Monascus purpureus*, *Monascus ruber*, and *Monascus pilosus*.

An example of the filamentous fungus mutant strain lacking expression of α-1,3-glucan according to the present invention is a filamentous fungus mutant strain deficient in at least one α-1,3-glucan synthase gene ags. Examples of the α-1,3-glucan synthase gene ags include: agsA (Genbank accession No. AN5885) and agsB (Genbank accession No. AN3307) of *Aspergillus nidulans*; agsA, agsB, and agsC of *Aspergillus oryzae*; agsA, agsB, and agsC of *Aspergillus sojae*; ags1 (Genbank accession No. AFUA_3G00910) of *Aspergillus fumigatus*; agsE (Genbank accession No. ANI_1_360084) of *Aspergillus niger*; and agsB (Genbank accession No. Pc16g06130) of *Penicillium chrysogenum*. In this connection, agsA, agsB, and agsC of *Aspergillus oryzae* are registered in the *Aspergillus* database AspGD (http://www.aspergillusgenome.org) with the following gene numbers: agsA (AOR_1_956014), agsB (AOR_1_2634154), and agsC (AOR_1_1350024). The putative amino acid sequence of AgsA of *Aspergillus oryzae* (SEQ ID NO: 1) is shown in FIG. 6, and the base sequence of a nucleic acid molecule encoding AgsA of *Aspergillus oryzae* (SEQ ID NO: 2) is shown in FIG. 7 and FIG. 8. The putative amino acid sequence of AgsB of *Aspergillus oryzae* (SEQ ID NO: 3) is shown in FIG. 9, and the base sequence of a nucleic acid molecule encoding AgsB of *Aspergillus oryzae* (SEQ ID NO: 4) is shown in FIG. 10 and FIG. 11. The putative amino acid sequence of AgsC of *Aspergillus oryzae* (SEQ ID NO: 5) is shown in FIG. 12, and the base sequence of a nucleic acid molecule encoding AgsC of *Aspergillus oryzae* (SEQ ID NO: 6) is shown in FIG. 13 and FIG. 14. The putative amino acid sequence of AgsA of *Aspergillus nidulans* (SEQ ID NO: 7) is shown in FIG. 15, and the base sequence of a nucleic acid molecule encoding AgsA of *Aspergillus nidulans* (SEQ ID NO: 8) is shown in FIG. 16 and FIG. 17. In addition, the putative amino acid sequence of AgsB of *Aspergillus nidulans* (SEQ ID NO: 9) is shown in FIG. 18, and the base sequence of a nucleic acid molecule encoding AgsB of *Aspergillus nidulans* (SEQ ID NO: 10) is shown in FIG. 19 and FIG. 20. In the present invention, examples of the amino acid sequences of AgsA, AgsB, and AgsC of *Aspergillus sojae* include amino acid sequences estimated from gene sequences registered in GenBank (Genbank accession Nos. DF093557 to DF093585) on the basis of homology with *Aspergillus oryzae*. The putative amino acid sequence of AgsA of *Aspergillus sojae* (SEQ ID NO: 11) is shown in FIG. 21, and the putative base sequence of a nucleic acid molecule encoding the above-mentioned AgsA of *Aspergillus sojae* (SEQ ID NO: 12) is shown in FIG. 22 and FIG. 23. In addition, the putative amino acid sequence of AgsB of *Aspergillus sojae* (SEQ ID NO: 13) is shown in FIG. 24, and the base sequence of a nucleic acid molecule encoding AgsB of *Aspergillus sojae* (SEQ ID NO: 14) is shown in FIG. 25 and FIG. 26. In addition, the putative amino acid sequence of AgsC of *Aspergillus sojae* (SEQ ID NO: 15) is shown in FIG. 27, and the base sequence of a nucleic acid molecule encoding AgsC of *Aspergillus sojae* (SEQ ID NO: 16) is shown in FIG. 28 and FIG. 29. The putative amino acid sequence of AgsE of *Aspergillus niger* (SEQ ID NO: 17) is shown in FIG. 30. The base sequence of a nucleic acid molecule encoding AgsE of *Aspergillus niger* (SEQ ID NO: 18) is shown in FIG. 31 and FIG. 32. The putative amino acid sequence of AgsI of *Aspergillus fumigatus* (SEQ ID NO: 19) is shown in FIG. 33. The base sequence of a nucleic acid molecule encoding AgsI of *Aspergillus fumigatus* (SEQ ID NO: 20) is shown in FIG. 34 and FIG. 35. The putative amino acid sequence of AgsB of *Penicillium chrysogenum* (SEQ ID NO: 71) and the base sequence of a nucleic acid molecule encoding AgsB thereof (SEQ ID NO: 72) are shown in FIG. 75.

Examples of the mutant filamentous fungus include mutant filamentous fungi each deficient in one or two or more of those α-1,3-glucan synthase genes. Of those, a mutant filamentous fungus deficient in all the three genes is preferred.

In the present invention, examples of the deficiency in α-1,3-glucan synthase gene ags include: a deletion of the whole or part of the coding region of α-1,3-glucan synthase in a genome; an insertion of another nucleic acid molecule into the whole or part of the coding region; and a substitution of the whole or part of the coding region by another nucleic acid molecule. In addition, the deficiency in α-1,3-glucan synthase gene ags encompasses not only an addition, deletion, and substitution of a predetermined nucleic acid molecule to the above-mentioned coding region but also a conditional gene deficiency designed so that α-1,3-glucan is expressed only under a certain condition.

The filamentous fungus mutant strain according to the present invention has a feature in not only lacking expression of α-1,3-glucan, but also being deficient also in at least part of the galactosaminogalactan (GAG) biosynthetic cluster.

Galactosaminogalactan is an extracellular polysaccharide identified in *Aspergillus fumigatus* in 2011, and is famed of galactose (Gal), N-acetylgalactosamine (GalNAc), and galactosamine (GalN) (Non-patent Literature 1). In addition, genes constituting the GAG biosynthetic cluster include uge3, sph3, ega3, agd3, and gtb3.

Therefore, an example of the filamentous fungus mutant strain deficient also in at least part of the GAG biosynthetic cluster according to the present invention is a filamentous fungus mutant strain deficient in at least one gene selected from the group consisting of uge3, sph3, ega3, agd3, and gtb3. In one embodiment of the present invention, an example of the filamentous fungus mutant strain deficient also in at least part of the GAG biosynthetic cluster is a filamentous fungus mutant strain deficient in at least uge3 and sph3 out of those genes.

Examples of those genes constituting the GAG biosynthetic cluster include: uge3 (Genbank accession No. AOR_1_2588174), sph3 (Genbank accession No. AOR_1_2586174), ega3 (Genbank accession No. AOR_1_2584174), agd3 (Genbank accession No. AOR_1_2582174), and gtb3 (Genbank accession No. AOR_1_2580174) of *Aspergillus oryzae*; uge3 (Genbank accession No. AN2951), sph3 (Genbank accession No. AN2952), ega3 (Genbank accession No. AN2953), agd3 (Genbank accession No. AN2954), and gtb3 (Genbank accession No. AN2955) of *Aspergillus nidulans*; uge3, sph3, ega3, agd3, and gtb3 of *Aspergillus sojae*; uge3 (Genbank accession No. ANI_1_1578024), sph3 (Genbank accession No. ANI_1_3046024), ega3 (Genbank accession No. ANI_1_1582024), agd3 (Genbank accession No. ANI_1_3048024), and gtb3 (Genbank accession No. ANI_1_3050024) of *Aspergillus niger*; uge3 (Genbank accession No. AFUA_3G07910), sph3 (Genbank accession No. AFUA 3G07900), ega3 (Genbank accession No. AFUA_3G07890), agd3 (Genbank accession No. AFUA_3G07870), and gtb3 (Genbank accession No. AFUA_3G07860) of *Aspergillus fumigatus*; uge3 (Genbank accession No. Pc20g06140), sph3 (Genbank accession No. Pc20g06130), ega3 (Genbank accession No. Pc20g06110), agd3 (Genbank accession No. Pc20g06090), and gtb3 (Genbank accession No. Pc20g06080) of *Penicillium chrysogenum*; uge3 (Gene ID: COCHEDRAFT_1185586), sph3 (Gene ID: COCHEDRAFT_1023805), ega3 (Gene ID: COCHEDRAFT_1023806), agd3 (Gene ID: COCHEDRAFT_1146217), and gtb3 (Gene ID: COCHEDRAFT_1146218) of *Cochliobolus heterostrophus* (anamorph: *Bipolaris maydis*); and uge3 (Gene ID: Bcin01p05750.1), sph3 (Gene ID: Bcin01p05740.1), ega3 (Gene ID: Bcin01p05730.1), agd3 (Gene ID: Bcin01p05720.1), and gtb3 (Gene ID: Bcin01p05710.1) of *Botrytis cinerea*.

The amino acid sequence of Uge3 of *Aspergillus oryzae* (SEQ ID NO: 21) and the base sequence of a nucleic acid molecule encoding Uge3 thereof (SEQ ID NO: 22) are shown in FIG. 36. In addition, the amino acid sequence of Sph3 of *Aspergillus oryzae* (SEQ ID NO: 23) and the base sequence of a nucleic acid molecule encoding Sph3 thereof (SEQ ID NO: 24) are shown in FIG. 37. In addition, the amino acid sequence of Ega3 of *Aspergillus oryzae* (SEQ ID NO: 25) and the base sequence of a nucleic acid molecule encoding Ega3 thereof (SEQ ID NO: 26) are shown in FIG. 38. In addition, the amino acid sequence of Agd3 of *Aspergillus oryzae* (SEQ ID NO: 27) and the base sequence of a nucleic acid molecule encoding Agd3 thereof (SEQ ID NO: 28) are shown in FIG. 39. In addition, the amino acid sequence of Gtb3 of *Aspergillus oryzae* (SEQ ID NO: 29) is shown in FIG. 40, and the base sequence of a nucleic acid molecule encoding Gtb3 of *Aspergillus oryzae* (SEQ ID NO: 30) is shown in FIG. 41 to FIG. 43.

The amino acid sequence of Uge3 of *Aspergillus nidulans* (SEQ ID NO: 31) and the base sequence of a nucleic acid molecule encoding Uge3 thereof (SEQ ID NO: 32) are shown in FIG. 44. In addition, the amino acid sequence of Sph3 of the above-mentioned *Aspergillus nidulans* (SEQ ID NO: 33) and the base sequence of a nucleic acid molecule encoding Sph3 thereof (SEQ ID NO: 34) are shown in FIG. 45. In addition, the amino acid sequence of Ega3 of *Aspergillus nidulans* (SEQ ID NO: 35) and the base sequence of a nucleic acid molecule encoding Ega3 thereof (SEQ ID NO: 36) are shown in FIG. 46. In addition, the amino acid sequence of Agd3 of *Aspergillus nidulans* (SEQ ID NO: 37) and the base sequence of a nucleic acid molecule encoding Agd3 thereof (SEQ ID NO: 38) are shown in FIG. 47. In addition, the amino acid sequence of Gtb3 of *Aspergillus nidulans* (SEQ ID NO: 39) is shown in FIG. 48, and the base sequence of a nucleic acid molecule encoding Gtb3 of *Aspergillus nidulans* (SEQ ID NO: 40) is shown in FIG. 49 to FIG. 51.

In the present invention, examples of the amino acid sequences of Uge3, Sph3, Ega3, Agd3, and Gtb3 of *Aspergillus sojae* include amino acid sequences estimated from gene sequences of *Aspergillus sojae* registered in GenBank (Genbank accession Nos. DF093557 to DF093585) on the basis of homology with *Aspergillus oryzae*. The putative amino acid sequence of Uge3 of *Aspergillus sojae* (SEQ ID NO: 41) and the putative base sequence of a nucleic acid molecule encoding Uge3 thereof (SEQ ID NO: 42) are shown in FIG. 52. The putative amino acid sequence of Sph3 of *Aspergillus sojae* (SEQ ID NO: 43) and the putative base sequence of a nucleic acid molecule encoding Sph3 thereof (SEQ ID NO: 44) are shown in FIG. 53. The putative amino acid sequence of Ega3 of *Aspergillus sojae* (SEQ ID NO: 45) and the putative base sequence of a nucleic acid molecule encoding Ega3 thereof (SEQ ID NO: 46) are shown in FIG. 54. In addition, the putative amino acid sequence of Agd3 of *Aspergillus sojae* (SEQ ID NO: 47) and the putative base sequence of a nucleic acid molecule encoding Agd3 thereof (SEQ ID NO: 48) are shown in FIG. 55. In addition, the putative amino acid sequence of Gtb3 of *Aspergillus sojae* (SEQ ID NO: 49) is shown in FIG. 56, and the putative base sequence of a nucleic acid molecule encoding Gtb3 of *Aspergillus sojae* (SEQ ID NO: 50) are shown in FIG. 57 to FIG. 59.

The putative amino acid sequence of Uge3 of *Aspergillus niger* (SEQ ID NO: 51) and the base sequence of a nucleic acid molecule encoding Uge3 thereof (SEQ ID NO: 52) are shown in FIG. 60. The putative amino acid sequence of Sph3 of *Aspergillus niger* (SEQ ID NO: 53) and the base sequence of a nucleic acid molecule encoding Sph3 thereof (SEQ ID NO: 54) are shown in FIG. 61. The putative amino acid sequence of Ega3 of *Aspergillus niger* (SEQ ID NO: 55) and the base sequence of a nucleic acid molecule encoding Ega3 thereof (SEQ ID NO: 56) are shown in FIG. 62. The putative amino acid sequence of Agd3 of *Aspergillus niger* (SEQ ID NO: 57) and the base sequence of a nucleic acid molecule encoding Agd3 thereof (SEQ ID NO: 58) are shown in FIG. 63. The putative amino acid sequence of Gtb3 of *Aspergillus niger* (SEQ ID NO: 59) is shown in FIG. 64. The base sequence of a nucleic acid molecule encoding Gtb3 of *Aspergillus niger* (SEQ ID NO: 60) is shown in FIG. 65 to FIG. 67. The putative amino acid sequence of Uge3 of *Aspergillus fumigatus* (SEQ ID NO: 61) and the base sequence of a nucleic acid molecule encoding Uge3 thereof (SEQ ID NO: 62) are shown in FIG. 68. The putative amino acid sequence of Sph3 of *Aspergillus fumigatus* (SEQ ID NO: 63) and the base sequence of a nucleic acid molecule encoding Sph3 thereof (SEQ ID NO: 64) are shown in FIG. 69. The putative amino acid sequence of Ega3 of *Aspergillus fumigatus* (SEQ ID NO: 65) and the base sequence of a nucleic acid molecule encoding Ega3 thereof (SEQ ID NO: 66) are shown in FIG. 70. The putative amino acid sequence of Agd3 of *Aspergillus fumigatus* (SEQ ID NO: 67) and the base sequence of a nucleic acid molecule encoding Agd3 thereof (SEQ ID NO: 68) are shown in FIG. 71. The putative amino acid sequence of Gtb3 of *Aspergillus fumigatus* (SEQ ID NO: 69) is shown in FIG. 72. The base sequence of a nucleic acid molecule encoding Gtb3 of *Aspergillus fumigatus* (SEQ ID NO: 70) is shown in FIG. 73 to FIG. 75. The putative amino acid sequence of Uge3 of *Penicillium chrysogenum* (SEQ ID NO: 73) and the base sequence of a nucleic acid molecule encoding Uge3 thereof (SEQ ID NO: 74) are shown in FIG. 79. The putative amino acid sequence of Sph3 of *Penicillium chrysogenum* (SEQ ID NO: 75) and the base sequence of a nucleic acid molecule encoding Sph3 thereof (SEQ ID NO: 76) are shown in FIG. 80. The putative amino acid sequence of Ega3 of *Penicillium chrysogenum* (SEQ ID NO: 77) and the base sequence of a nucleic acid molecule encoding Ega3 thereof (SEQ ID NO: 78) are shown in FIG. 81. The putative amino acid sequence of Agd3 of *Penicillium chrysogenum* (SEQ ID NO: 79) is shown in FIG. 82. The base sequence of a nucleic acid molecule encoding Agd3 of *Penicillium chrysogenum* (SEQ ID NO: 80) is shown in FIG. 83. The putative amino acid sequence of Gtb3 of *Penicillium chrysogenum* (SEQ ID NO: 81) is shown in FIG. 84. The base sequence of a nucleic acid molecule encoding Gtb3 of *Penicillium chrysogenum* (SEQ ID NO: 82) is shown in FIG. 85 to FIG. 87.

The putative amino acid sequence of uge3 of *Cochliobolus heterostrophus* (anamorph: *Bipolaris maydis*) (SEQ ID NO: 89), the base sequence of a nucleic acid molecule of uge3 (SEQ ID NO: 90), the putative amino acid sequence of sph3 thereof (SEQ ID NO: 91), and the base sequence of a nucleic acid molecule of sph3 thereof (SEQ ID NO: 92) are shown in FIG. 95. The putative amino acid sequence of ega3 of *Cochliobolus heterostrophus* (anamorph: *Bipolaris maydis*) (SEQ ID NO: 93), the base sequence of a nucleic acid molecule of ega3 thereof (SEQ ID NO: 94), the putative amino acid sequence of agd3 thereof (SEQ ID NO: 95), and the base sequence of a nucleic acid molecule of agd3 thereof (SEQ ID NO: 96) are shown in FIG. 96 and FIG. 97. The putative amino acid sequence of gtb3 of *Cochliobolus heterostrophus* (anamorph: *Bipolaris maydis*) (SEQ ID NO: 97) and the base sequence of a nucleic acid molecule of gtb3 thereof (SEQ ID NO: 98) are shown in FIG. 98 to FIG. 101.

The putative amino acid sequence of ags1 of *Botrytis cinerea* (SEQ ID NO: 99) and the base sequence of a nucleic acid molecule of ags1 thereof (SEQ ID NO: 100) are shown in FIG. 102 to FIG. 104. The putative amino acid sequence of uge3 of *Botrytis cinerea* (SEQ ID NO: 101), the base sequence of a nucleic acid molecule of uge3 thereof (SEQ ID NO: 102), the putative amino acid sequence of sph3 thereof (SEQ ID NO: 103), and the base sequence of a nucleic acid molecule of sph3 thereof (SEQ ID NO: 104) are shown in FIG. 105. The putative amino acid sequence of ega3 of *Botrytis cinerea* (SEQ ID NO: 105), the base sequence of a nucleic acid molecule of ega3 thereof (SEQ ID NO: 106), the putative amino acid sequence of agd3 thereof (SEQ ID NO: 107), and the base sequence of a nucleic acid molecule of agd3 thereof (SEQ ID NO: 108) are shown in FIG. 106 and FIG. 107. The base sequence of a nucleic acid molecule of gtb3 of *Botrytis cinerea* (SEQ ID NO: 109) and the base sequence of a nucleic acid molecule of gtb3 thereof (SEQ ID NO: 110) are shown in FIG. 108 to FIG. 111.

In the present invention, examples of the deficiency in at least part of the GAG biosynthetic cluster include: a deletion of the whole or part of a coding region out of the GAG biosynthetic cluster in a genome; an insertion of another nucleic acid molecule into the whole or part of the coding region; and a substitution of the whole or part of the coding region by another nucleic acid molecule. In addition, the deficiency in at least part of the GAG biosynthetic cluster encompasses not only an addition, deletion, and substitution of a predetermined nucleic acid molecule to the above-mentioned coding region but also a conditional gene deficiency designed so that GAG is expressed only under a certain condition.

In addition, in the present invention, examples of the deficiency in uge3 include: a deletion of the whole or part of a Uge3 coding region in a genome; an insertion of another nucleic acid molecule into the whole or part of the coding region; and a substitution of the whole or part of the coding region by another nucleic acid molecule. In the present invention, examples of the deficiency in sph3 include: a deletion of the whole or part of an Sph3 coding region in a genome; an insertion of another nucleic acid molecule into the whole or part of the coding region; and a substitution of the whole or part of the coding region by another nucleic acid molecule. In the present invention, examples of the deficiency in ega3 include: a deletion of the whole or part of an Ega3 coding region in a genome; an insertion of another nucleic acid molecule into the whole or part of the coding region; and a substitution of the whole or part of the coding region by another nucleic acid molecule. In the present invention, examples of the deficiency in agd3 include: a deletion of the whole or part of an Agd3 coding region in a genome; an insertion of another nucleic acid molecule into the whole or part of the coding region; and a substitution of the whole or part of the coding region by another nucleic acid molecule. In the present invention, examples of the deficiency in gtb3 include: a deletion of the whole or part of a Gtb3 coding region in a genome; an insertion of another nucleic acid molecule into the whole or part of the coding region; and a substitution of the whole or part of the coding region by another nucleic acid molecule.

In addition, also for uge3, sph3, ega3, agd3, and gtb3, the deficiency in each of these genes encompasses not only an addition, deletion, and substitution of a predetermined nucleic acid molecule to the above-mentioned coding region but also a conditional gene deficiency designed so that GAG is expressed only under a certain condition.

The filamentous fungus mutant strain deficient in at least part of the GAG biosynthetic cluster according to the present invention preferably encompasses not only a filamentous fungus mutant strain completely lacking expression of GAG but also a filamentous fungus mutant strain substantially lacking expression of GAG. More specifically, the mutant strain substantially lacking expression of GAG refers to a mutant strain that expresses only a small amount of GAG and shows significant suppression of aggregation of cells, which is the effect of the present invention, and an example thereof is a strain having an expression amount of GAG of 30% or less with respect to that of a wild-type strain, more preferably 10% or less with respect to that of the wild-type strain.

A method of the present invention may be used for the production of useful substances, for example, enzymes such as amylase and cellulase and low-molecular-weight compounds such as penicillin that the filamentous fungus originally has abilities to produce. In the method of the present invention, transformation may be performed so as to enhance the expression of the useful substances that the filamentous fungus originally has abilities to produce, or so as to express substances that the filamentous fungus originally has no abilities to produce. As such transformation method, a method known per se (e.g., methods described in JP 2001-46078 A, JP 2005-52116 A, JP 2009-118783 A, JP 11-506025 A, and JP 2007-508022 A) may be used, the method involving utilizing an expression vector constructed so that the filamentous fungus can function as a host, and a plasmid constructed by functionally linking a gene encoding a homologous or heterologous protein to the expression vector.

A method of producing such mutant strain may be performed by subjecting a filamentous fungus to, for example, the following, by appropriately using a method known per se (e.g., methods described in Non-patent Literatures 2 to 5): the construction of a disruption cassette for α-1,3-glucan gene and the introduction of the cassette into a genome gene; and the construction of a disruption cassette for a gene constituting the GAG biosynthetic cluster and the introduction of the cassette into a genome gene. In the present invention, as the filamentous fungus to be subjected to such genetic manipulation, there may be used, for example, a filamentous fungus having a mutation of gene ligD disruption and/or gene adeA disruption (preferably both thereof) introduced in advance in order to enable gene introduction into a target site at a high probability. Here, ligD is a gene associated with nonhomologous recombination repair in DNA repair, and is preferred because a transformant having the gene introduced into the target site through homologous recombination can be acquired with relatively high efficiency by disrupting the gene. An example of the mutation that disrupts the gene is a ligD::sC mutation obtained by disruption using an sC marker (Non-patent Literature 6). In addition, adeA is an adenine auxotrophic gene, and an example of the mutation that disrupts the gene is adaAΔ:: ptrA obtained by disruption with pyrithiamine resistance gene (ptrA) (Non-patent Literature 7). Therefore, examples of the filamentous fungus mutant strain of the present invention also include filamentous fungus mutant strains further having those mutations.

The filamentous fungus mutant strain according to the present invention may be used for the production of a substance, and may be used for, for example, the following method.

Method of Producing Substance

The present invention provides a method of producing a substance, including the steps of:

culturing the above-mentioned filamentous fungus mutant strain to allow the filamentous fungus to produce a substance; and collecting the resulting substance.

The useful substances that can be produced by the method of the present invention are not particularly limited as long as the substances can be produced by the filamentous fungus, and examples thereof include: low-molecular-weight compounds such as penicillin, statins, cephalosporin, kojic acid, citric acid, and malic acid; and high-molecular-weight compounds such as amylase, cellulase, protease, lipase, peptidase, esterase, hydrophobin, and oxidase. In addition, examples of the useful substances include chemical products such as an organic acid, a pigment, and an agricultural chemical bulk, and various substances to be used as pharmaceutical products. In addition, the method of the present invention is also applicable to, for example, the production of bioethanol through biomass decomposition (e.g., one using a mold genetically modified so as to highly produce cellulase or the like). By the method of the present invention, a cell wall constituent component or a hydrolysate thereof may be produced, but a substance other than the cell wall constituent component or the hydrolysate thereof may also be produced. Examples of the cell wall constituent component or the hydrolysate thereof include α-1,3-glucan, β-1,3-glucan, polygalactose, glucose, galactose, glucosamine, amino acid, mannose, N-acetylglucosamine, N-acetylgalactosamine, and chitin. In the present invention, the "substance" that can be produced by the method of the present invention is understood not to encompass: a compound that harms or kills the filamentous fungus; living cells; a substance that can only be obtained by chemical synthesis; and the like.

Culturing Step

The method of the present invention includes a step of culturing a mutant filamentous fungus lacking expression of α-1,3-glucan to allow the filamentous fungus to produce a substance. A medium to be used in the step is not particularly limited, and there may be used a wide range of media that may be used for the culture of a filamentous fungus. Examples thereof include CD minimal medium, YPD medium, TSB medium, malt medium, and PDA medium. To the medium, glucose, starch, soluble starch, or the like may be added as a carbon source. The addition amount of such carbon source is not particularly limited and may be appropriately set within a range of, for example, from 0.5% to 10%, more preferably from 1% to 4%. A culture temperature is not particularly limited and may be appropriately set within a range of from 20° C. to 45° C., more preferably from 25° C. to 37° C. A culture time is also not particularly limited and may be appropriately set within a range of, for example, from 12 hours to 72 hours, more preferably from 24 hours to 48 hours. In addition, as described above, the filamentous fungus mutant strain according to the present invention also encompasses a filamentous fungus mutant strain having a conditional gene deficiency designed so that α-1,3-glucan and/or GAG is expressed only under a certain condition. Therefore, the method of the present invention also encompasses a method including a step of culturing a mutant strain having the conditional gene deficiency under such a condition that α-1,3-glucan and GAG are not expressed (or their expressions are suppressed).

Collecting Step

A method of collecting the useful substance from the culture medium is not particularly limited, and there may be appropriately used a method known per se (e.g., centrifugation, recrystallization, a distillation method, a solvent extraction method, or chromatography). The method of the present invention is a method of collecting a useful substance. Therefore, a method of decomposing and detecting constituent components of a filamentous fungus mutant for the purpose of analyzing constituent components of cells of a filamentous fungus itself or the like for research thereof is essentially different from the method of the present invention.

Now, an embodiment of the present invention is more specifically described by way of Examples, and the action and effect of the present invention are demonstrated. These Examples are for illustrative purposes and for specific description, and the present invention is not limited to these Examples.

EXAMPLES

Example 1

Materials and Methods

Strain

In this study, a modified strain of an NS4 strain (genotype; niaD⁻, sC⁻) was used as a wild-type strain of a filamentous fungus *A. oryzae*. The NS4 modified strain used in this study is a strain having introduced therein a ligDΔ::sC mutation capable of gene introduction into a target site at a high probability and an adaAΔ::ptrA mutation having adenine auxotrophy (ligDΔ::sC, adaAΔ::ptrA). In addition, a strain deficient in three kinds of α-1,3-glucan synthase genes (agsAΔagsBΔagsCΔ) was used as an AG-deficient strain. Other produced gene mutant strains and genotypes thereof are as shown in Table 1.

TABLE 1

| Strain *A. oryzae* | Genotype | Reference |
|---|---|---|
| NS4 ligDΔ::sC. adeAΔ::ptrA | ligDΔ::sC, adeAΔ::ptrA, niaD−, adeA+ | Mizutani et. al (2008) Fungal. Gent. Biol. 45, 878-889. |
| agsAΔagsBΔagsCΔ | ligDΔ::sC, adeAΔ::ptrA, niaD−, adeA+, agsA::loxP, agsB::loxP, agsC::loxP | Miyazawa et al (2016) Biosci. Biotechnol. Biochem. 80, 1853-1863. |
| agsAΔagsBΔagsCΔ sph3Δuge3Δ | ligDΔ::sC, adeAΔ::ptrA, niaD−, agsA::loxP, agsB::loxP, agsC::loxP, sph3uge3::adeA | This study |
| sph3Δuge3Δ | ligDΔ::sC, adeAΔ::ptrA, adeA+, niaD−, sph3uge3::loxP | This study |
| NS4 O/E cutL1 | ligDΔ::sC, adeAΔ::ptrA, adeA+, PglA142-cutL1-TagdA::niaD | Miyazawa et al (2016) Biosci. Biotechnol. Biochem. 80, 1853-1863. |
| agsAΔagsBΔagsCΔ O/E cutL1 | ligDΔ::sC, adeAΔ::ptrA, adeA+, agsA::loxP, agsB::loxP, agsC::loxP, PglaA142-cutL1-TagdA::niaD | Miyazawa et al (2016) Biosci. Biotechnol. Biochem. 80, 1853-1863. |
| agsAΔagsBΔagsCΔ sph3Δuge3Δ O/E cutL1 | ligDΔ::sC, adeAΔ::ptrA, agsA::loxP, agsB::loxP, agsC::loxP, sph3Δuge3Δ::adeA, PglaA142-cutL1-TagdA::niaD | This study |

Medium

In this study, Czapek-Dox (CD) medium was used as a selection minimal medium for *A. oryzae*. In addition, YPD medium was used as a nutrient-rich medium. Herein, CD medium having added thereto 70 mM sodium glutamate in place of sodium nitrate as a nitrogen source was used in the culture of a niaD⁻ strain (this medium is hereinafter referred to as CDE medium). In addition, in the culture of an adeA⁻ strain, adenine sulfate was added at a final concentration of 0.01% (this medium is hereinafter referred to as CDEA medium). The compositions of media and culture solutions are as shown in Table 2. In the case of using a medium as an agar plate medium, agar was added to the medium at a final concentration of 1.5% (w/v).

TABLE 2

Compositions of media used in this study
For plate culture, 1.5% agar added

| *A. oryzae* Czapek-Dox(CD) medium (/liter) | |
|---|---|
| 10× stock solution | 100 ml |
| 1000× trace elements solution | 1 ml |
| 1M MgSO$_4$ | 2 ml |
| Glucose | 20 g |
| 10× stock solution (/liter) | |
| NaNO$_3$ | 60 g |
| KCl | 5.2 g |
| KH$_2$PO$_4$ | 152 g |
| Adjust to pH 6.5 with 10N KOH | |
| 1000× trace elements solution (/liter) | |
| FeSO$_4$•7H$_2$O | 1.0 g |
| ZnSO$_4$•7H$_2$O | 8.8 g |
| CuSO$_4$•5H$_2$O | 0.4 g |
| MnSO$_4$•4H$_2$O | 0.15 g |
| Na$_2$B$_4$O$_7$•10H$_2$O | 0.1 g |
| (NH$_4$)$_6$Mo$_7$O$_{24}$•4H$_2$O | 0.05 g |
| 10× stock solution (Glutamate) (/liter) | |
| C$_5$H$_8$NNaO$_4$ | 130.9 g |
| KCl | 5.2 g |
| KH$_2$PO$_4$ | 15.2 g |
| Adjust to pH 6.5 with 10N KOH | |
| YPD medium (/liter) | |
| Peptone | 20 g |
| Yeast extract | 10 g |
| Glucose | 20 g |

TABLE 2-continued

Compositions of media used in this study
For plate culture, 1.5% agar added

| YPM medium (/liter) | |
|---|---|
| Peptone | 20 g |
| Yeast extract | 10 g |
| Maltose | 20 g |

Culture

In this study, the culture of *A. oryzae* was performed at 30° C., unless otherwise stated. In the case of agar plate culture, a plate was left to stand still, and in the case of liquid culture, rotary shaking culture was performed at 120 rpm.

Spore Suspension

Conidia of *A. oryzae* were inoculated into agar plate medium of CD medium satisfying the auxotrophy of each kind of mutant strain, and were cultured at 30° C. for about 7 days until conidia were sufficiently formed. Further, the conidia were subcultured in malt medium at 30° C. for about 4 days until conidia were sufficiently formed. 10 mL per plate of a sterilized conidial suspended solution (150 mM NaCl, 0.1% Tween 20, 10 mM phosphate buffer (pH 7.2)) was poured on agar plate medium, and the conidia were scraped with a cell spreader to be suspended. For the purpose of removing hyphae mixed in the suspension, the suspension was filtered using a sterilized cell strainer (pore size: 70 μm) or sterilized MIRACLOTH (Calbiochem), and only the conidia were collected in a Falcon tube having a volume of 50 mL or a volume of 15 mL to prepare a conidial suspension. The number of the conidia was measured using a Thoma hemocytometer.

Production of Uge3/Sph3 Gene Disruption Cassette

The uge3 and sph3 genes of *A. oryzae* are adjacent to each other. Therefore, a disruption cassette for disrupting both the genes at once was produced. First, a uge3 downstream (5' side) region (amplicon 1) and an sph3 downstream (3' side) region (amplicon 2) were amplified by PCR using genomic DNA of *A. oryzae* as a template. In addition, AnadeA gene (amplicon 3) was amplified from plasmid TOPO-2.1-adeA by PCR (1st round of PCR). PCR amplification was performed using: primers Sph3+Uge3-LU and Sph3+Uge3-LL+Ade for amplicon 1; primers Sph3+Uge3-RU+Ade and Sph3+Uge3-RL for amplicon 2; and primers Sph3+Uge3-AU and Sph3+Uge3-AL for amplicon 3 (Table 3). The primers Sph3+Uge3-LL+Ade, Sph3+Uge3-AU, Sph3+Uge3-RU+Ade, and Sph3+Uge3-AL each contain, on the 5' side, a homologous sequence to a complementary strand, for linking by fusion PCR. The PCR product was gel-extracted, and subjected to PCR using the primers Sph3+Uge3-LU and Sph3+Uge3-RL to link those three fragments (2nd round of PCR). A main band of the PCR product was gel-extracted, and used as a uge3/sph3 gene disruption cassette.

TABLE 3

Sequences of PCR primers used for production of uge3/sph3 gene disruption cassette

| Name | Sequence 5' | Direction | nt | Gene |
|---|---|---|---|---|
| Sph3 + Uge3 – LU | TCTCCATAGTGTTCACCA | Forward | 18 | uge3 |
| Sph3 + Uge3 – LL + Ade | ATATACCGTGACTTTTTAGCACAACATTGGAGCTACT | Reverse | 37 | uge3 |
| Sph3 + Uge3 – RU + Ade | AGTTTCGTCGAGATACTGCGCGTTGTCATATTTGCAAG | Forward | 38 | sph3 |
| Sph3 + Uge3 – RL | AGGGCTCAGAATACGTATC | Reverse | 19 | sph3 |
| Sph3 + Uge3 – AU | AGTAGCTCCAATGTTGTGCTAAAAAGTCACGGTATATCATGAC | Forward | 43 | AnadeA |
| Sph3 + Uge3 – AL | TTGCAAATATGACAACGCGCAGTATCTCGACGAAACTACCTAA | Reverse | 43 | AnadeA |

Transformation of *A. oryzae* by Protoplast-PEG Method

Transformation of *A. oryzae* was performed using a protoplast-PEG method (Non-patent Literature 8). The wild-type strain and the AG-deficient strain (agsAΔagsBΔagsCΔ) were each used as a host strain. $2 \times 10^8$ conidia of the host strain were inoculated into 200 mL of YPD liquid medium in an Erlenmeyer flask having a volume of 500 mL, and were subjected to rotary shaking culture at 30° C. for 20 hours. The cells were filtered through sterilized MIRACLOTH (Calbiochem) to collect the cells. The cells were washed with distilled water, and the cells were dehydrated by being pressed with a sterilized spatula. The collected cells were placed in a Falcon tube having a volume of 50 mL, and suspended by adding 25 mL of a protoplast forming solution [10 mg/mL Lysing Enzymes (Sigma), 5 mg/mL Cellulase Onozuka (Yakult Pharmaceutical Ind. Co., Ltd), 2.5 mg/mL Yatalase (TaKaRa), Lysing enzyme buffer (Table 4)] that had been filtered through a filter DISMIC-25CS (ADVANTEC) having a pore size of 0.20 μm. The suspension was shaken at 30° C. and 83 rpm for 3 hours to digest cell walls, to thereby prepare protoplasts. After the reaction, undigested cells were filtered through sterilized MIRACLOTH, and the filtrate was centrifuged at 4° C. and 2,000×g for 5 minutes to collect the protoplasts. The collected protoplasts were washed with 0.8 M NaCl, and centrifuged at 4° C. and 2,000×g for 5 minutes to precipitate and collect the protoplasts. The protoplasts were added to Sol. I (Table 4) at $2 \times 10^8$ protoplasts/mL and suspended therein. After that, a ⅕ amount of Sol. II (Table 4) was added, and the contents were mixed well. 240 μL of the protoplast liquid was dispensed in a Falcon tube having a volume of 15 mL, a DNA solution was added in an appropriate amount (from about 1 μg to about 10 μg), and the contents were mixed well and left to stand in ice for 25 minutes. Next, 1 mL of Sol. II (Table 4) was added, and the contents were mixed well and then left to stand at room temperature for 20 minutes. 10 mL of Sol. I was added, and the contents were mixed well and then centrifuged at room temperature and 2,000×g for 5 minutes. The supernatant was removed, and 300 μL of Sol. I was added. The protoplasts were homogeneously suspended, and seeded into CD selection medium (Table 2) containing 0.8 M NaCl. After that, 5 mL of soft agar medium of the same composition [0.6% (w/v) Agar] that had been warmed to 55° C. was poured from the periphery and overlaid so as to quickly and homogeneously suspend the protoplasts. After that, the protoplasts were cultured at 30° C. until colonies were formed.

TABLE 4

Buffers used in genetic experiment in this study
Buffer

| TE buffer | |
|---|---|
| 10 mM | Tris-HCl |
| 1 mM | EDTA |
| 50× TAE buffer | |
| 2M | Tris base |
| 0.1M | EDTA |
| Adjust to pH 8.0 with glacial acetatic add | |
| Spore suspension buffer | |
| 150 mM | NaCl |
| 0.1% | Tween20 |
| 10 mM | Phosphate buffer (pH 7.2) |

TABLE 4-continued

Buffers used in genetic experiment in this study
Buffer

| For fungal transformation | |
|---|---|
| Lysing enzyme buffer | |
| 0.8M | NaCl |
| 10 mM | Sodium phosphate buffer (pH 6.0) |
| Sol. I | |
| 0.8M | NaCl |
| 10 mM | $CaCl_2$ |
| 10 mM | Tris-HCl (pH 8.0) |
| Sol. II | |
| 40% | PEG 4000 |
| 50 mM | $CaCl_2$ |
| 50 mM | Tris-HCl (pH 8.0) |

Selection of Transformed Strain Candidate

In order to confirm whether the genomic DNA of the resulting transformed strain candidate had been transformed as intended, the genomic DNA was simply extracted from the conidia of the strain, and the transformed strain was selected by PCR using designed primers. 500 μL of YPD liquid medium was taken in a 1.5 mL Eppendorf tube, and the conidia of the transformed strain candidate were poked with a sterilized toothpick and inoculated, followed by culture at 30° C. until cells were grown. After centrifugation, the medium was removed. Glass beads in an amount equal to that of the cells and 150 μL of Nuclei Lysis Sol. (Promega) were added, and the cells were pulverized with Micro Smash™ MS-100R (TOMY) at 4,500 rpm for 2 minutes. The resultant was left to stand at 65° C. for 15 minutes, 100 μL of Protein Prep. Sol. (Promega) was added, and the contents were mixed well. The mixture was left to stand at room temperature for 5 minutes and centrifuged at 4° C. and 15,000 rpm for 5 minutes, and then the supernatant was transferred to another 1.5 mL tube. A ¹⁄₁₀ amount of 3 M sodium acetate and a 2.5-fold amount of ethanol were added, and the contents were mixed. After centrifugation at 4° C. and 15,000 rpm for 20 minutes, the pellets were washed with 1 mL of 70% ethanol and dissolved in 50 μL of RNase-containing TE. The resulting solution was defined as a genomic DNA solution, and stored at 4° C. until being used as a template for PCR.

Nucleus Purification

The transformed strain candidate of interest was grown on minimum agar plate medium, and the collected conidial suspension was passed through a mononucleation filter (ISOPORE™ MEMBRANE FILTERS, 5.0 μm TMTP, Millipore) that had been sterilized by autoclave treatment in advance, to thereby collect mononucleate conidia. The conidial suspension subjected to the mononucleation treatment was appropriately diluted, and grown on minimum agar plate medium. The resulting strain candidate was confirmed again by PCR. Thus, the transformed strain of interest was purified.

Liquid Shaking Culture in YPD Medium

The wild-type strain, the AG-deficient strain, or the AG-GAG-deficient strain was used and subjected to liquid shaking culture in YPD medium for 24 hours. The temperature was set to 30° C., the number of revolutions was set to 120 rpm, the scale of the medium was set to a 50 mL/200 mL Erlenmeyer flask (without baffles), and conidia were inoculated at $1 \times 10^5$ conidia/mL.

Polybutylene Succinate-Co-Adipate (PBSA) Decomposition Ability Test with Strain Highly Expressing cutL1

The produced AG-GAG-deficient strain highly expressing cutL1 was subjected to a PBSA decomposition ability test in order to confirm the introduction of the plasmid for highly expressing cutL1. CDE (2% maltose) medium containing 1% PBSA was used for the test. Conidia were inoculated at the center of the medium and subjected to static culture at 30° C. for 4 days, and formed halos were observed. As controls, a wild-type strain highly expressing cutL1 and an AG-GAG-deficient strain not highly expressing cutL1 were used.

Quantification of CutL1 Secretion Amount

Proteins in 100 µL of the culture supernatant were purified by TCA precipitation, appropriately diluted, and subjected to SDS-PAGE (buffer compositions were as shown in Table 5). As a standard, 0.4 µg to 2 µg of purified α-amylase (derived from *A. oryzae*, Sigma-Aldrich) or 0.2 ng to 1 ng of purified CutL1 quantified by a BCA method was used. An image of a gel detected by SDS-PAGE was taken into ImageJ, and a band of interest was converted into a pixel value. A calibration curve was prepared from the standard to quantify an endogenous amylase or CutL1 secretion amount.

TABLE 5

| Buffers used in SDS-RAGE | |
| --- | --- |
| SDS-PAGE Sample buffer | |
| Tris-HCl (pH 8.8) | 0.12M |
| Glycerol | 10% (v/v) |
| SDS | 5% (w/v) |
| 2-mercaptoethanol | 5% (v/v) |
| Bromophenol blue | 0.05% (w/v) |
| SDS-PAGE running buffer | |
| Tris base | 50 mM |
| Glycine | 384 mM |
| SDS | 0.10% |

Liquid Shaking Culture in YPM Medium

The wild-type strain highly expressing cutL1, the AG-deficient strain highly expressing cutL1, or the AG-GAG-deficient strain highly expressing cutL1 was used and subjected to liquid shaking culture in YPM medium (Table 2) for 24 hours. The temperature was set to 30° C., the number of revolutions was set to 100 rpm, the scale of the medium was set to a 50 mL/200 mL Erlenmeyer flask, and conidia were inoculated at $1\times10^4$ conidia/mL.

Experimental Results

Estimation of GAG Biosynthetic Gene Cluster in *A. oryzae*

On the basis of five gene cluster sequences considered to be responsible for GAG biosynthesis in *A. fumigatus*, a database (AspGD) was searched as to whether or not the same gene cluster was also present in *A. oryzae*. As a result, it was suggested that the cluster gene sequences were also present in *A. oryzae*, and the ORFs of gtb3 (AOR_1_2580174), agd3 (AOR_1_2582174), ega3 (AOR_1_2584174), sph3 (AOR_1_2586174), and uge3 (AOR_1_2588174) were GAG biosynthetic genes in *A. oryzae* (FIG. 1A).

Production of Strain Deficient Only in GAG and AG-GAG-Deficient Strain (FIG. 2)

The wild-type strain and the AG-deficient strain were each used as a parental strain, and the uge3/sph3 gene disruption cassette was introduced into the genome thereof by a protoplast-PEG method. The selection of transformants was performed with adeA-free CDE agar plate medium. The resulting transformants were subjected to nucleus purification, and confirmed by PCR amplification using primers Sph3+Uge3-LU and Sph3+Uge3-RL.

Culture Properties of Strain Deficient Only in GAG and AG-GAG-Deficient Strain (FIG. 3)

The strain deficient only in GAG formed a large hyphal aggregate as compared to the wild-type strain. In addition, the hyphae aggregated to form a hyphal aggregate in each of the wild-type strain and the AG-deficient strain, whereas the AG-GAG-deficient strain did not show aggregation of hyphae and was observed to be in a state in which the hyphae were completely dispersed in liquid medium. Hitherto, a mutant strain of *A. oryzae* showing culture properties of being completely dispersed as described above has not been known. In addition, on agar plate medium, the AG-GAG-deficient strain showed growth comparable to that of the wild-type strain.

Acquisition of Strain Highly Expressing cutL1 for AG-GAG-deficient Strain (FIG. 4)

The AG-GAG-deficient strain was used as a host strain and transformed with pNGA-gla-cut (Takahashi et al., 2005), a plasmid for highly expressing cutL1. For the selection of a strain highly expressing cutL1, CD medium containing 0.8 M NaCl was used, and a transformed strain candidate showing nitric acid autotrophy was acquired. The resulting transformant was subjected to nucleus purification, and confirmed by PCR amplification using primers niaD-tail-Fw and cutL1-RT-F.

Further, a halo formation test was performed using CDE (2% maltose) medium containing 1% PBSA. As a result, in the AG-GAG-deficient strain highly expressing cutL1, halo formation comparable to that of the wild-type strain highly expressing cutL1 used as a control was observed. This suggested that the plasmid for highly expressing cutL1 had been properly introduced.

Evaluation of CutL1 Productivity of AG-GAG-Deficient Strain

As a result of culture in YPM medium, the dry cell weight at 24 hours of culture had increased in the order of the wild-type strain, the AG-deficient strain, and the AG-GAG-deficient strain. In particular, the dry cell weight of the AG-GAG-deficient strain had significantly increased to be about 10 times that of the wild-type strain (FIG. 5A). In addition, the CutL1 production amount had also increased in the order of the wild-type strain, the AG-deficient strain, and the AG-GAG-deficient strain, and the CutL1 production amounts of the AG-deficient strain and the AG-GAG-deficient strain had significantly increased to be about 2.5 times that of the wild-type strain and about 5 times that of the wild-type strain, respectively (FIG. 5B). The results suggested that the AG-GAG-deficient strain showing complete dispersibility had properties suitable for high production of a substance in high-density culture.

CR Sensitivity Test on AGA and AG-GAGA Strains

Figure 88:
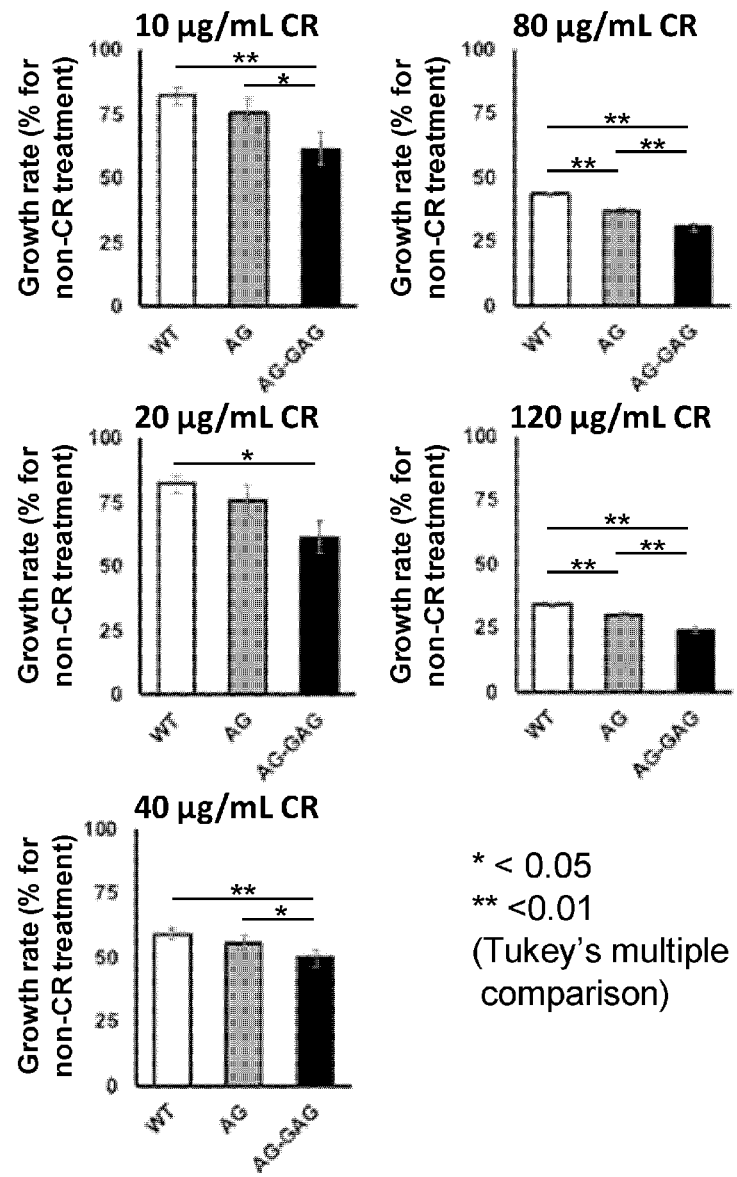
FIG. 88 Test results on the Congo red (CR) sensitivity of the WT strain, the AGA strain, and the AG-GAGA strain are shown.

2 µL of a conidial suspension of the WT strain, the AGA strain, or the AG-GAGA strain prepared at $5\times10^3$/µL was spotted (a total of $1\times10^4$ conidia/plate) at the center of CD agar medium containing Congo red (CR) at 0 µg/mL, 10 µg/mL, 20 µg/mL, 40 µg/mL, 80 µg/mL, or 120 µg/mL, and incubated at 30° C. for 3 days. A colony diameter after the 3 days was measured, and a growth rate on CR-containing medium was calculated with reference to a colony diameter in the case of no CR (FIG. 88). The results were as follows: the AG-GAGA strain had lower growth rates than the wild-type strain and the AGA strain at all concentrations. This suggested that not only AG but also GAG was associated with CR sensitivity.

Analysis of Cell Wall Constituent Saccharides of *Aspergillus* AG-GAGA Strain

The cell wall components of the wild-type (WT) strain, AGA strain, AG-GAGA strain, and GAGA strain of an *Aspergillus* were analyzed by fractionating the polysaccharide components of cells through the use of a hot water/alkali extraction method, and quantifying monosaccharide components contained in a sulfuric acid hydrolysate of each fraction. First, conidia of each strain were inoculated into 200 mL of YPD medium (2% peptone, 1% yeast extract, 2% glucose) at a final concentration of $1.0 \times 10^5$/mL, and subjected to shaking culture at 30° C. and 120 rpm for 24 hours. After the culture, the culture solution was filtered through MIRACLOTH. The resulting cells were washed with water. The cells were lyophilized, and then pulverized with a mixer mill. Next, 1 g of dry cell powder of each strain was fractionated into a hot-water-soluble (HW) fraction, an alkali-soluble/water-soluble (AS1) fraction, an alkali-soluble (AS2) fraction, and an alkali-insoluble (AI) fraction in accordance with the method of Yoshimi et al. (Yoshimi et al., PLoS ONE, 2013) (Table 6).

TABLE 6

| | Hot water/alkali extraction | | | |
|---|---|---|---|---|
| (%) | HW | AS1 | AS2 | AI |
| WT | 32.0 ± 2.8 | 7.0 ± 0.6 | 14.8 ± 0.4 | 46.2 ± 2.4 |
| AGΔ | 35.7 ± 1.4 | 6.9 ± 0.5 | 12.1 ± 2.1 | 45.2 ± 0.8 |
| AG-GAGΔ | 35.5 ± 0.4 | 7.8 ± 0.3 | 12.0 ± 0.3 | 44.8 ± 0.7 |
| GAGΔ | 36.6 ± 0.5 | 7.5 ± 0.3 | 17.6 ± 1.1 | 38.2 ± 0.7 |

Figure 89:
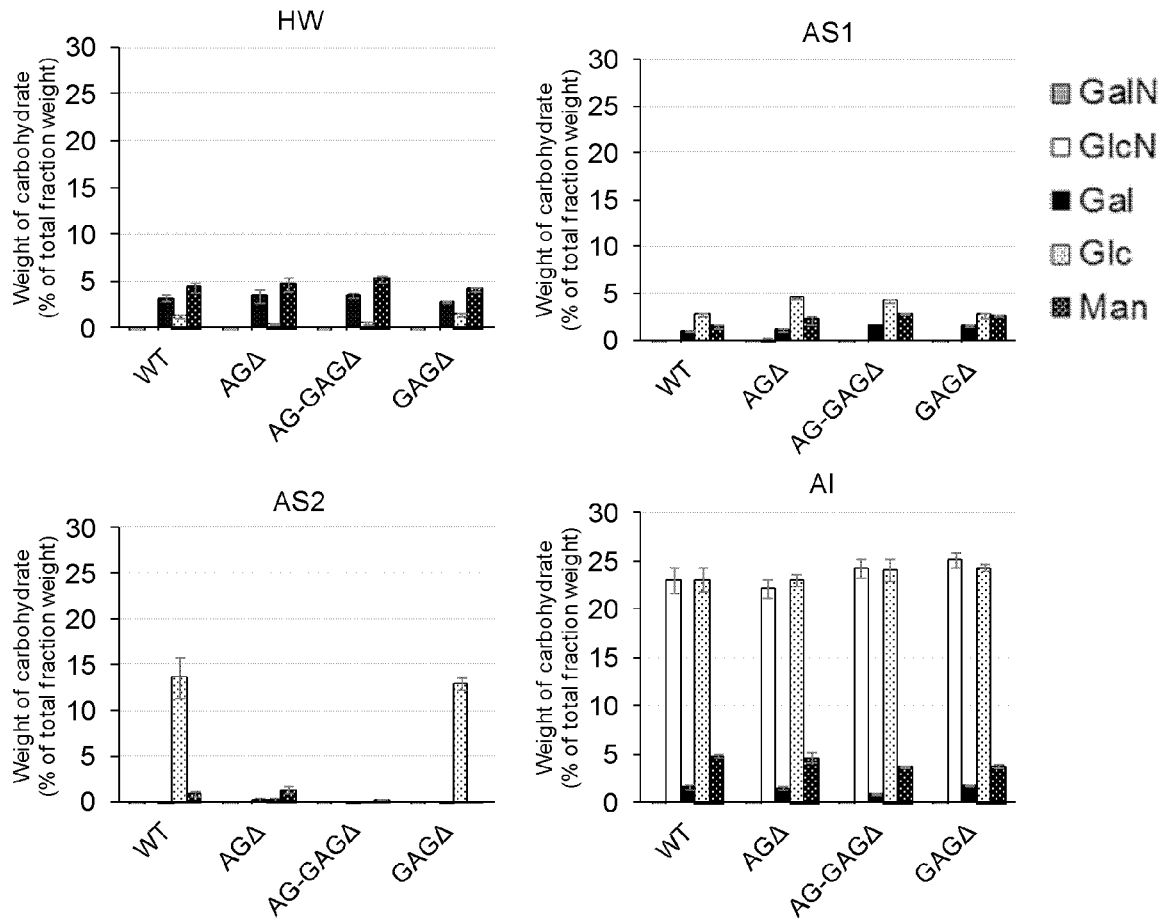
FIG. 89 Analysis results of the cell wall constituent saccharides of a wild-type (WT) strain, AGA strain, AG-GAGA strain, and GAGA strain of an *Aspergillus* are shown.

It is known from the report of Yoshimi et al. that α-1,3-glucan is mainly contained in the AS2 fraction, and β-1,3-glucan and chitin are mainly contained in the AI fraction (Yoshimi et al., PLoS ONE, 2013). 10 mg of each of those four fractions was used and heated in the presence of 2 N $H_2SO_4$ at 100° C. for 12 hours to decompose the polysaccharide components in the fraction into monosaccharides. Each of the hydrolyzed fractions was neutralized with barium carbonate, and centrifuged to provide a supernatant. The monosaccharide components contained in the hydrolysate of each fraction were separated using an anion-exchange column Carbo PAC PA-1 (4×250 mm, DIONEX) and a guard column Carbo PAC under the conditions of a flow rate of 1 mL/min, a column temperature of 35° C., a compartment temperature of 20° C., and an eluent of 18 mM NaOH, and were detected using a pulsed amperometric detector. The monosaccharide components were quantified using 1 μg/mL to 100 μg/mL galactosamine, glucosamine, galactose, glucose, and mannose as standards. In addition, 10 μg/mL fucose was used as an internal standard. As a result, no significant difference was found among the monosaccharide components of the HW, AS1, and AI fractions of each strain (FIG. 89). In contrast, in the AS2 fraction, the AGA strain and the AG-GAGA strain were remarkably reduced in glucose amount as compared to the wild-type strain (FIG. 89). This suggested that the cell walls of the AGA strain and the AG-GAGA strain hardly contained α-1,3-glucan.

Figure 90:
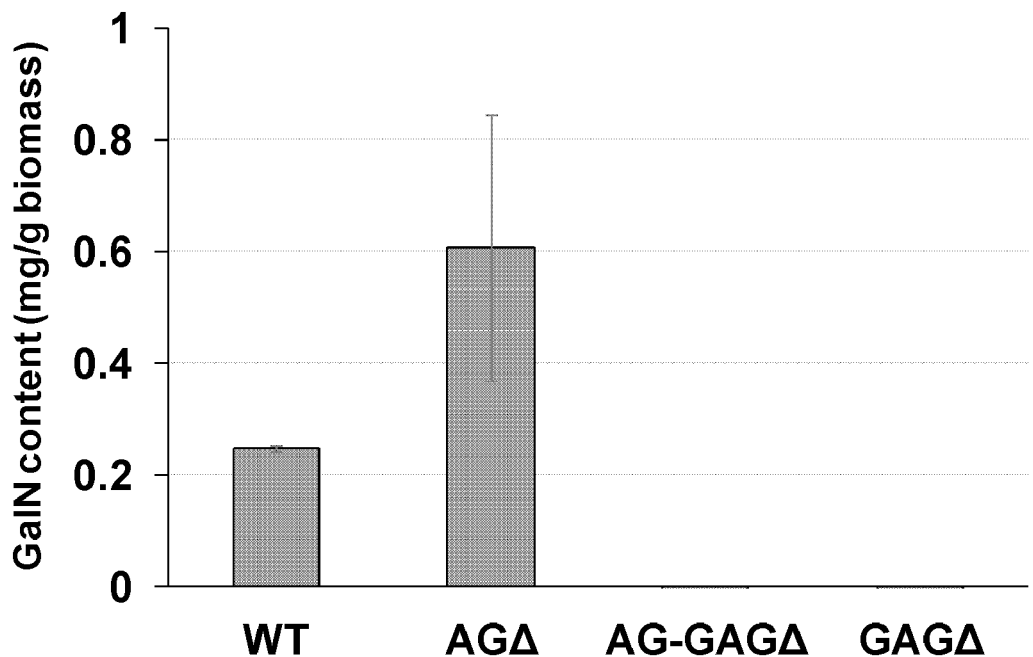
FIG. 90 Results of sulfuric acid hydrolysis and monosaccharide component analysis of the wild-type (WT) strain, AGA strain, AG-GAGA strain, and GAGA strain of an *Aspergillus* are shown.

In addition, 50 μg of the HW fraction of each strain was subjected to sulfuric acid hydrolysis and monosaccharide component analysis by the same methods as described above. The results were as follows: the wild-type strain and the AGA strain contained 0.25 mg and 0.60 mg of galactosamine per 1 g of grown cells, respectively, whereas no galactosamine was detected in the AG-GAGA strain (FIG. 90). No previous study has reported a polysaccharide containing galactosamine other than GAG in the cell wall of a filamentous fungus of the genus *Aspergillus*. This revealed that the cell wall of the AG-GAGA strain contained no GAG.

Example 2

Generation and Culture Properties of GAG Disruption Strain in *Cochliobolus heterostrophus*

*Cochliobolus heterostrophus* (anamorph: *Bipolaris maydis*) has in its genome a gene cluster homologous to the galactosaminogalactan biosynthetic gene cluster (sequence information, FIG. 1A). This cluster includes five genes, and a construct for substituting regions corresponding to sph3 and uge3 out of those genes by hygromycin resistance gene was produced (FIG. 91A). First, a HITO7711 strain serving as a wild-type strain of *Cochliobolus heterostrophus* was subjected to shaking culture (120 rpm) in complete medium (CM: 1.5 g $Ca(NO_3)_2 \cdot 4H_2O$, 0.5 g $MgSO_4 \cdot 7H_2O$, 0.5 g KCl, 0.4 g $KH_2PO_4$, 30 mg $K_2HPO_4$, 10 g glucose, 1.0 g tryptone, and 1.0 g yeast extract per liter) at 25° C. for 36 hours, and the cells were collected by filtration through MIRACLOTH. Next, the cells were treated with a protoplast forming liquid (50 mg/mL lysing enzyme, 5 mg/mL Cellulase onozuka, 2.5 mg/mL Yatalase in 10 mM Na phosphate buffer, pH 6.0) to produce protoplasts. The produced protoplasts were used and transformed by a protoplast-PEG method in accordance with the method of Yoshimi et al. (Yoshimi et al., 2004, Mol. Gen. Genomics 271: 228-236). Genomic DNA was extracted from one gene disruption strain candidate thus obtained, and gene disruption was confirmed by PCR. As a result, bands of about 3.5 kb and about 5.5 kb to be amplified only in the case of successful gene disruption were found (FIG. 91B), and thus the strain was confirmed to be a GAG disruption strain having the regions corresponding to sph3 and uge3 deleted as designed.

Next, the GAG disruption strain thus obtained was subjected to shaking culture in YPM medium using maltose as a carbon source (2% peptone, 1% yeast extract, 2% maltose) (25° C., 120 rpm, 72 hour), and culture properties were observed. The results were as follows: the wild-type strain grew while forming aggregates of hyphae (FIG. 92A), whereas the hyphae of the GAG disruption strain tended to be dispersed (FIG. 92B). This characteristic is similar to that of the AG-GAG-deficient strain of *A. oryzae*, and hence it is suggested that GAG deficiency provides a culture characteristic suitable for high-density culture also in *C. heterostrophus*.

Example 3

Generation and Culture Properties of AG-GAG Disruption Strain in *Botryotinia fuckeliana*

*Botryotinia fuckeliana* (anamorph: *Botrytis cinerea*) has in its genome a gene cluster homologous to the galactosaminogalactan biosynthetic gene cluster (sequence information, FIG. 93A). This cluster includes five genes, and a construct for substituting regions corresponding to sph3 and uge3 out of those genes by hygromycin resistance gene was produced (FIG. 93A). First, an AG disruption strain of *Botryotinia fuckeliana* was subjected to shaking culture (120 rpm) in complete medium (CM: 1.5 g $Ca(NO_3)_2 \cdot 4H_2O$, 0.5 g $MgSO_4 \cdot 7H_2O$, 0.5 g KCl, 0.4 g $KH_2PO_4$, 30 mg $K_2HPO_4$, 10 g glucose, 1.0 g tryptone, and 1.0 g yeast extract per liter) at 25° C. for 36 hours, and the cells were collected by filtration through MIRACLOTH. Next, the cells were treated with the protoplast forming liquid described above to produce protoplasts. The produced protoplasts were used and transformed by a protoplast-PEG method in the same manner. Genomic DNA was extracted from 24 gene disruption strain candidates thus obtained, and gene disruption was confirmed by PCR. As a result, bands of about 3.5 kb and about 5.5 kb to be amplified only in the case of successful gene disruption were found (FIG. 93B) in two strains, and thus these strains were each confirmed to be a GAG disruption strain having the regions corresponding to sph3 and uge3 deleted as designed.

Next, the GAG disruption strain thus obtained was subjected to shaking culture in YPM medium using maltose as a carbon source (2% peptone, 1% yeast extract, 2% maltose) (25° C., 120 rpm, 72 hour), and culture properties were observed. As described later, when AG expression on the cell surface of the GAG disruption strain of *B. cinerera* was detected with an α-1,3-glucanase-glucan binding domain-GFP fusion under the above-mentioned culture conditions (FIG. 112), it was found that no expression of AG was detected, which was substantially comparable to that of the AG-GAG disruption strain of *A. oryzae*. Accordingly, under the above-mentioned culture conditions, although the GAG disruption strain of *B. cinerera* is deficient only in GAG, whereas the wild-type strain grew while forming aggregates of hyphae (FIG. 94A), the hyphae of the GAG disruption strain of *B. cinerera* tended to be more dispersed than those of the wild-type strain (FIG. 94B). This property is similar to that of the AG-GAG disruption strain of *A. oryzae*, suggesting the possibility that *Botryotinia fuckeliana* can be made suitable for high-density culture merely by GAG disruption.

AGBD-GFP Method and Results

Cells (WT or AG-GAGA of *Aspergillus oryzae*; WT or GAGΔ of *Botrytis cinerea*; or WT or GAGΔ of *Cochliobolus heterostrophus*) were mounted on a slide glass, and fixed by being incubated at 65° C. for 15 minutes. The fixed cells were immersed in 10 μL of an AGBD-GFP solution (100 μg/mL in 50 mM potassium phosphate buffer) and incubated at 30° C. for 3 hours. AGBD-GFP is a recombinant protein obtained by fusing the α-1,3-glucan-binding site of α-1,3-glucanase and GFP, and can specifically stain α-1,3-glucan (Suyotha et al (2013) Biosci. Biotechnol. Biochem. 77: 639-647.). After the 3 hours of reaction, the cells were washed with 50 mM potassium phosphate buffer 3 times, and observed with a fluorescence microscope. As a result, definite fluorescence derived from α-1,3-glucan was observed in the cells of *A. oryzae* serving as an *Aspergillus*, whereas no fluorescence was observed in the AG-GAGA strain (FIG. 112). In addition, also in the case of *B. cinerea*, no fluorescence was observed in each of the wild-type strain and the GAGA strain (FIG. 112). Therefore, it was suggested that *B. cinerea*, though having α-1,3-glucan synthase, did not express α-1,3-glucan under the culture conditions in question.

In addition, as a matter of course, no fluorescence derived from α-1,3-glucan was observed in *C. heterostrophus* having no α-1,3-glucan synthase (FIG. 113).

INDUSTRIAL APPLICABILITY

According to the present invention, in the method of producing a substance using a filamentous fungus, the production amount of a useful substance can be drastically increased. In addition, a wide variety of useful substances can be produced without any particular limitation by the method of the present invention. Thus, the method of the present invention is extremely useful in industry.

SEQUENCE LISTING (110 sequences)

SEQ ID NO: 1 - protein, 2396 aa, Aspergillus oryzae
MKWGFTGPLLALLAATAAGWPYDESLVDYNLNVNKDTTNPAEYTHAEWKGHEYNPSPKSWRFPFYTLFIDRFVNGDPTNDNINGSLFEHDLNSNQMRHGGDAAGLVDTLDYLQGMGIKGIYLAGTILMNQPWGSDGYSILDTTLLDQHYGTIQTWRDAITEIHKRGMYVLFDNTIATMGDLIGFEGYLNTTTPFSVKEHKALWKSDRQYVDFRFDNEYNNTCEYPRFWNETGYPVDKDVTDELVGCYNSDFDQYGDREAFGVYPDWERQLAKFASVQDRLREWHPSVKERLIRHSCMIIKALDIDGFRYDKATQATVDALGDMSHAYRECARSVGKDNFFLPGEITGGNNFGSIYLGRGRQPNQYPDSSLASMNLTNTSDHQYFLRDDGLQALDSAAFHYSVYRTLTRFLGMDGNLAAGYDTPLDWTDSWNIMVLSNDMINANTGKFDPRHMYGTTNQDVFRWPAIELGVERQLLGHFITTLHLPGIPILLWGEEQAFYILDSTADNYIYGRQAMSPSTAWKTHGCYSLGSSQYYNWPVSAGREGCHDEAVAYDHRDPSHPVHNIIKHMFQMRQDFPVLNDGYSVVKLSKQTREIQYPGSNGTATEVGVWSVLRDLVSNIQDFGDSGNNEPVWLVYQNDNKTVEYSFDCGSNDSALISPFTTGTTVVNLFYPHDEHELKDGPKSLHLNGTNATNGCLDTLKLKPFEFRAYVPKANFVKPRPMITQFEPGHDVPQLSKVGPDESEDIDVSIYFSTKMDCDQVTKSISFESSTEAGKTPSISNNSVSCKDAKGDDPKWTGQIPNAWVWTAKLTGVYNGIHRLTVKNATSSDGHSSTQATDHFLIRVGQRDNPLVFTSANYSTSLLNQYDNGTLYIQHRAAGANKYRYSTNFGSSFSDWKDYHGGNDTIEELPWSGTDKQKWQGKHVRVEYWNKLTGSSDYAQEGDSGYDHPRRFPHLFFNGPFNQYGYDAGLDNVVRQDSDGLWKFRFMAEFPAQGQFNVWGMNPDGQPDQSYVFGDVDDDGVLDRMPPSSLSSTIINITDIPPSPYLAWNLGVDDGTLRVHLLPTGSRTIQMVVYFLLWFVPLVTAIACVYAFVKSFYQVKFNQVGVSEKKSILPLAFRRKLSRDGSGGSINPFMRLANKSGFLQSTPAFGAVASRRRTTLIATMEYDIEDWAIKIKIGGLGVMAQLMGKHLGQQDLIWVVPCVGGVDYPVDQPAEPMFVTVLGNSYEVKVQYHVLNNIKYVLLDAPVFRQQTKSEPYPARMDDLDSAIYYSAWNQCIAQAIRRFPIDLYHINDYHGSIAPLYLLPQTIPVCLSLHNAEFQGLWPMRTQKERDEVCSVFNLDLDTAKRYVQFGEVFNMLHAGASYLRVHQQGFGAVGVSRKYGKRSYARYPIFWGLKKVGNLPNPDPSDTGEWNKELPKDSEIRVDPNYEASRGELKRQAQEWAGLDQNPDADLLVFVGRWSMQKGVDLIADVMPAVLEARPNVQLICVGPVIDLYGKFAALKLDHMMRLYPGRVFSKPEFTALPAYIFSGAEFALIPSRDEPFGLVAVEFGRKGALGIGARVGGLGQMPGWWYNIESTTTSHLLHQFKLAIGSALNSKPQVRAKMRARSAKQRFPVAQWVEDLEILQTTAMRIHSKGQAKSNGGPLSPSGYNTPSEVITPSGMMTPTIASTGTTTPTGMQTPPIAHSREGSYTNLSVNRDSAYGPQQRNTIVYSRDPSPGGNDEPRLSLGRQLSLGFRAGPGHINLRGRRLKRRSQMTNEESGTATEESSDDDYFRGEEEVTITREQADEGRHQRNAPRSLASPPNSYFEEGITSGRPPWAQPGNRLSSASVLSVDSVVGEKKDYKLQKVDPFFTDGTGEYYRMFDQRLEKLNGSNSESQLCIEEYLMKSEKKWFDKFRDARLGRNQSPASSIFQTKGENNTPMSSISHEDLGSNESGSDPRAEKDEFLLGRDYVPPSGLRKWMQIRIFGWPVYSFFLGLGQIIAANSYQITLLAGENGQTAEKLYGIATVYLVTSIIWWFFFRFFKSVFVLSIPWFLYGASFVIIGLAHFESNGSARGWIQNVGSGVYAAASSSGSLFFALNFGDESGVQVKDWVFRACLIQGTQQAYVIGLWYWGTTISSAVANGVTNVNGGIVNSWKMTAICMPIAAFLWAIGLIIFFGLPNYYRQSPGKVPSFYKSVFRRKIVLWNFVVVILQNFFLSAPYGRNWAFLWSSNHAEAWQVGILVVVFFGVIWVAVLTLFGYLSKRHSWILPVFACGLGAPRWAQIWWGVSGMGLFLPWAGSSVSGALASRSLWLWLGILDALQGLGFGMILLQTLTRVHIAFTLLASQVLGSIATIVARACAPNNIGPGPISPDVTAGGSSVANAWFWIALFFQLLICAGFLLFFRKEQLTKP

SEQ ID NO: 2 - DNA, 7488 bp, Aspergillus oryzae
atgaagtggggattcactggcccgttgcttgcgttgctcgcagcaacagcagcaggctggccctatgatgagtccctagtcgattataacttgaatgtgaacaaggatactaccaatccggctgaatatactcacgcagaatggaagggccatgagtataatccctctccaaaaagctggcgattccccttctataccctgttcattgaccggtttgtcaatggcgatcctactaacgataacatcaacgggtcactctttgaacatgatcttaattcaaaccaaatgcgtcacggtggtgatgcagctggcttggtcgatacactagactacctacaaggtatgggcataaaggttggtagcaatgatctccgtgttgtttcttgctattggtgtttaccgcatatggctgactgacctctacaggggatctatttggctggtactatcttgatgaatcaaccatggggctcagacggttactcgattttggatactaccctgcttgatcagcattatggtacaattcaaacctggagagacgcgatcaccgagattcataagcggggcatgtatgtcctctttgacaatactatcgcaacgtaagatgctgcccctcacctaagtcgttatatcccagagctgacatgaaaccagcatgggcgatttgattggatttgaaggttatttgaatactaccacgcctttctcagtcaaggagcacaaagcattgtggaaatctgaccgtcagtatgtcgacttccgttttgacaatgagtacaacaacacttgcgaataccctcgattctggaacgagactggctatccggtcgataaggatgtcacagatgagctggttggatgctataacagtgatttcgaccagtacggtgacagagaagctttcggtgtctacccagactgggagcgccagttggccaaattcgcttcagttcaggatcgtctacgtgaatggcaccctagcgttaaagagagacttattcggcactcgtgtatgattataaaggcacttgacattgatggcttccgctacgataaagcgacgcaggccacagtggatgctcttggagacatgtcccatgcttatagagagtgtgctcgcagtgttggcaaggataacttcttccttcctggagaaattactggtggaaataactttggttctatttacctcggacgtggaagacagcccaaccaatacccagactcctccttggcttcgatgaacctgacgaacacctccgatcatcagtatttcttacgtgatgacggtctacaagcgctagattcagcagctttccattattcggtgtaccgtaccctcactcgattcctaggtatggatggcaatctggctgcgggctatgacacaccgttggactggacggactcctggaatattatggtattgagcaacgatatgatcaatgctaacactggcaaatttgacccccggcatatgtatggtactacaaaccaggatgttttccgttggcctgccatcgagctcggagtcgagagacagcttttgggtcacttcatcacaaccttgcatctcccgggcatcccaattttgctgtggggagaagaacaagccttctacattctagactctactgcggataactatatctatggccgccaagcaatgtctccctccactgcgtggaaaacacacggatgttattcccttggttcgtcccaatactacaactggcctgtcagtgcaggtagggaaggatgtcatgatgaagctgtcgcttatgatcatcgagatccctctcatccagtccacaatatcatcaaacatatgttccagatgcgacaggacttccctgtactaaatgatggatactcagttgtcaagttgtcaaaacagactcgtgagattcagtatcctggttcgaatggcacggcaacggaagtcggcgtctggtcagtcctgcgtgatcttgtctccaacattcaagactttggtgacagcggcaacaacgaacctgtctggctggtctatcaaaatgacaacaagaccgtggaatatagctttgattgtgggagtaacgattcggccttgatttccccatttactacgggaactactgttgttaatctcttctacccacacgatgaacacgagcttaaagatggccccaaatcacttcatctgaacggcaccaatgcaacaaacggttgtctggatactttgaagttgaagcccttcgagttcagggcttacgttccaaaggctaactttgttaagcctcgtcccatgatcacccagttcgagcctggtcacgatgtgccgcagctgtctaaagtcggacctgacgaatcagaagatattgacgtgagcatttacttttccaccaagatggattgtgatcaggttacgaaatccatttcattcgaatccagtaccgaagctggcaagactccctctatcagtaataacagtgtcagctgcaaagatgccaagggtgatgatccgaagtggactggtcaaattcccaacgcctgggtctggacagcgaagttgactggcgtttacaacggtatccatcgcttgaccgtcaaaaatgccactagctcggatgggcatagttctacccaggcaactgatcacttcttgatccgagtgggccaaagggataatccgttggtgttcacatctgcgaactactcgacctccttgttaaaccagtatgacaatggcacgctctacatccaacatcgtgcagcaggtgcaaacaaataccgctattcaacaaactttggttcctcattctctgactggaaagactaccacggagggaacgatactattgaagaactgccctggagtggaacggacaagcaaaagtggcaagggaagcacgtgcgagtcgaatactggaataagttaaccggcagcagtgactacgctcaggaaggcgactctggatatgaccatccaagacgctttccccatcttttcttcaacgggccattcaaccaatatggatatgatgcgggcttggacaacgttgtgaggcaagacagtgatggtctttggaagttcagattcatggctgagtttccagcacaaggacagttcaatgtttggggaatgaatccagatggtcaaccagaccagagctacgtgttcggtgatgttgatgatgacggagttttggatcgcatgcctccttcttcgcttagttccacgataataaacatcacggatatccctccatctccatacttggcgtggaatcttggtgttgacgatggaactctgcgtgttcatcttctgccaacgggttcaaggaccatccaaatggttgtgtacttcctcctctggtttgttccccttgtcacagccatcgcttgtgtctatgccttcgtgaaatccttctaccaagtcaagttcaaccaagtgggggtcagcgaaaagaaatcaattcttccattggcattccgaaggaaactgagccgtgatggaagcgggggatcaatcaatcctttcatgcgccttgccaataagtcgggattcttgcaaagcacacctgcttttggagcagtcgcttcacgaagacggacgaccttgattgccaccatggaatatgatattgaggactgggccatcaagattaaaatcggtggtctaggtgttatggctcagttgatgggcaaacaccttgggcagcaggatctaatttgggttgttccatgcgtgggtggagttgactacccggtagatcagccagctgagcctatgtttgtgacagtgctcggaaattcctacgaagtcaaggtgcagtatcacgtcctgaataatattaaatatgtccttttagatgctcctgtttttcgtcaacagaccaaatctgagccttatcccgcccgaatggacgatttggacagcgcaatctactattccgcttggaaccagtgcattgcacaagcaatcagacgtttcccaattgatctttatcatattaacgactaccatggatccattgcccctctttatcttctacctcaaaccatccctgtatgtctgtcgctccacaatgccgagttccaaggactgtggcctatgcgcacccagaaggagagggatgaagtctgttctgttttcaaccttgatcttgacactgcaaagcgctacgtccaatttggcgaagtttttaacatgcttcatgctggagcaagctacctacgcgtgcatcaacaagggtttggtgcagtgggcgtttctcgaaagtacggtaaacgttcttatgcccggtacccaatcttttggggtctgaagaaggttggaaatctaccgaacccggacccttcagacactggcgaatggaacaaggagttaccaaaggacagcgagattcgggttgacccgaactacgaggctagcagaggagagcttaagcggcaggcgcaggaatgggcaggcttggatcaaaaccctgatgccgacctgttggtgtttgttggaagatggtctatgcagaagggcgtggaccttattgctgatgtgatgcctgccgttctggaagcacgtcccaatgttcaactcatctgtgttggtccagtcattgatctttatggtaaatttgctgctcttaagctggatcatatgatgaggttatatcctgggcgtgtcttctcaaagcctgagtttactgcactcccagcatatatcttctctggcgccgaattcgccctgattccatctcgtgatgaaccttttggtcttgttgctgtcgaatttggtcgaaagggcgctcttggtattggtgctcgtgttggtggtctcggccagatgcctggttggtggtataatattgagtctacaacaacttcccatctcttgcatcaattcaagcttgcgattggaagcgcgcttaactcgaagccccaagttcgtgcaaagatgcgtgcacgctccgcaaagcaacgctttcctgttgctcagtgggtggaagatttggaaattctgcagaccactgctatgcggattcacagcaagggacaggcaaaatcgaacggtggacctctctcgccttctggttacaatacaccaagtgaagtaataacaccaagtggaatgatgacacctacgattgcatcgactggtaccacgaccccaacgggaatgcagacgcctccaatcgcacactcacgggaaggcagttacacgaatctcagcgtcaatcgcgacagtgcatacgggccccaacagcgcaacacaattgtgtacagccgtgacccaagccctggaggtaatgacgaacctaggttaagccttggtcggcaactgtcacttggattcagggctggaccaggacatattaatctccgtggtcgtcggcttaaaagaagaagccagatgaccaacgaggagagtggtacagcgaccgaagaaagcagtgatgacgattatttccgcggagaggaagaagttacgattacgagggagcaagcagatgaaggacgtcatcaacgcaatgctccgaggtcgcttgcatctcctcccaactcttactttgaagaaggcataacatccggaaggccaccttgggctcaacctgggaatcgactcagtagtgcatccgttctttctgttgattctgtcgtcggcgaaaagaaagactataagctgcagaaagttgatccattcttcacagacggtactggcgaatactatcgaatgtttgatcagagactcgaaaagctcaacggatctaactctgaatcccagctttgtatagaggagtatctgatgaagagcgaaaagaagtggtttgacaagttcagagacgcaagattggggcgcaaccaatctcccgcttcttcgattttccaaaccaagggcgaaaacaacacacctatgagctcaatctcccacgaggatctgggttcaaacgaaagtggcagcgatccacgcgcagaaaaggatgagttccttctgggacgagactatgttcccccctcgggcttaaggaaatggatgcaaattcgaatctttggctggcctgtgtattcgtttttcctaggtctcggtcagatcattgcggccaactcataccaaattaccttgcttgccggtgaaaacggccagacagctgagaagctctatggtattgcgacagtataccttgtcacttcaatcatctggtggtttttcttccgcttcttcaaatcggtgtttgtcctttccataccttggttcttatacggcgcatcgtttgtcatcattggattagcacactttgagtcaaatggctccgctcgtggatggatccagaatgtgggaagcggtgtttacgctgctgcttcttcaagcggatcactgttcttcgctctcaattttggcgatgaaagcggtgttcaggttaaagactgggttttccgggcatgcctcatccaaggaacccagcaagcatatgttattggactgtggtactggggaacgacaatctctagcgctgtcgccaatggagttaccaacgtcaacggcggcattgtcaactcctggaaaatgacgtatgtttcacctttatcactatgattacaattgctaacggcctcttctagcgcaatctgcatgccaatcgctgcattcctctgggccattggtctgataatcttcttcggcctgcccaattactaccgccagtcacctggaaaagttccatcattctacaagtctgtcttccggcgcaagatcgtcctgtggaacttcgtggtagtcattttgcaaaatttcttcctcagcgcaccttatggacgaaactgggcctgtaagtacatcagacctatactctccaagaagccactaacttatcgtgcctcatacagtcctttggagctcaaaccatgccgaagcctggcaagtcggcatcctcgtcgtcgtcttcttcggtgtcatctgggtagcagtgttaaccctatttggatatctctcgaagcgccatagctggattctacctgtatttgcatgcggtttgggagctccacgttgggcccagatatggtggggtgtctccggaatgggtctcttccttccctgggctggcagttctgttagcggagcactcgcatcacgaagtctatggctctggctcggtatccttgatgccttacagggtctcggcttcggcatgattcttctccagaccctcacacgagtacatatagccttcaccctgcttgcatctcaagtgctgggatccatcgcgacaatcgtcgccagagcatgtgctccaaataacatcggtcctggaccaatctcgccggatgtgactgccggtggcagttccgttgcaaacgcttggttctggatcgccttattcttccagctcttgatctggtaagtcatcgatccccctacaatccatttcacaggcagcaaaatgctaacaaagccccagcgccggattccttctgttcttccggaaagaacaactcaccaagccctaa

SEQ ID NO: 3 - protein, 2422 aa, Aspergillus oryzae
MKWAFSSAVLALFATTVKAWPYEESLSAYNLNENKSATNPAQYWGEWPDHKGKYFPSPDNWRFPVYTLFMDRFVNGDPTNDNINGTLFEHDISSTQMRHGGDVAGLVDTLDYLQGMGIKAIYLAGTILMNQPWGSDGYSALDTTLLDQHFGDIATWRNAIDEIHKRGMYVIFDNTIATMGDLIGFEGHLNDTTPFSVKEHKALWKSNRRYVDFDIGNDYNQTCDYPRFWYEDGYPVQQSMTEGLVGCYDSDFDQYGDIEAFGVFPDWQRQLAKFASVQDRLREWHPSVRERLIRHSCMIIYQLDIDGFRYDKATQSTVDALGDMSMAYRECARAVGKENFFISGEITGGNTFGSIYLGRGRQPNQYPETAEKAMKMTNESESQYFLREAGHEAIDGAAFHYSTYRALTRFLGMDGNLAAGYDVPVDWVDAWNLMLQSNDFINPNTGKFDPRHMFGATNQDVFRWPTVEKGVERQLLGLYITTLLLPGIPLLLWGEEQAFYILDATASNYIYGRQAMSPATAWRDHGCFSLDSSQYYQWPIQAGREGCHDPTAAYDHRDPAHPVRNIIKHMYQLREDFPVLNDGYSVQKLSNLTEEVFYPGSNGTATETGLWSILRDVNADVQDLGSDAKNQPVWLVYHNTNRTIDFKFNCKDNETALISPFATGTKVRNLFYPYDEHTLIDGPVKLGLNGSTELNGCLANMTLDAYEFRAYVPSARFTKPRPMITQFTPGHDVPVRSTVAPNLDESVKIELYFSEEMDCDSVTKAISISSSTESKKVPTLDEKTVDCKGIPASNTSWTGQLPSVFMWAANLTGVYNGIHRVTVKNASSTNGNATTNAVDHFLFRIGQIDNPMVFTSANYSTSLLHEESNGTLFIQHHAAGADKWRYSTNWGTTFSEWKDYTGGNDTITELEWSGTKKQRWKGHHVRVEYWSKWTGSSDYVQEGDAGVHSNVPRRFPHIFFNGPYNQYGYDGGLDNVVRQDSKDGLWKYHFTAEWPAQAQLNIWGMNPDGKPDQSWVLGDADNDSVLDRMPPSSLSATLINITEHPPKPYLAWNIYINDATMKFQLFPVGHQNTQIAMFVLFWIIPVITGAACVYIFMKSFYKVKFNQIGVSEKATLIPLALRRKFKRNRGGDEERMNPLMRLANKSGFLQTNTAIGGAASGKRRMVLIATMEYDIEDWQIKIKIGGLGVMAQLMGKTLGHQDLIWVVPCVGGVEYPVDKPAEPMNVTILGNSYEVQVQYHVLNNITYVLLDAPVFRQQSKSEPYPARMDDLNSAIYYSAWNQCIAEACKRFPIDLYHINDYHGSLAPLYLLPDTVPACLSLHNAEFQGLWPMRTQKEKEEVCSVFNLDIDIVRRYVQFGEVFNLLHSGASYLRVHQQGFGAVGVSKKYGKRSYARYPIFWGLRKVGNLPNPDPSDVGEWSKEKAIGNADEVHVDPDYEAGRADLKRQAQEWAGLDVNPDADLMVFVGRWSMQKGVDLIADVMPAVLEARPNVQVICVGPVIDLYGKFAALKLDHMMKVYPGRVFSRPEFTALPPYIFSGAEFALIPSRDEPFGLVAVEFGRKGALGIGARVGGLGQMPGWWYNVESTATSHLLYQFKLAIDAALNSKQETRAMMRARSAKQRFPVAQWVEDLEILQTTAIQVHNKELVKHNGRPFTPTGTTTPSGLMTQPASPLGTPGMQTPLAHSRESSYSNLNRLSEYVTQPKTSYSRDPSPSGTEKPKSGLQRQLSLGVRSGPGHQSRRGRARQRDSIPEHEDTQEAHGGAITDVEEESSDDDIVNHYADDEYTLTPAQVEEGRRLQAAQQQAGGRRYSQDSLHPRNVQPPSSPGTPPAASQSLLPPPRLLDPGSRLSSASVLSLDSVVGGKKDFKLQKVDPFFTDSTGEYYKIFDKKLDELNGSNSESQLCIEEYLIKSEKEWFDKFRDARLGRTKSPTPSVYRDKHGASPIGSFYDDNGSRMSGSDGPHSNDSEDDEFLLGKDYVPPTGLKKWMQIRIGDWPIYSLFLALGQIIAANSYQITLLTGEVGQTAEKLYGIATTYLITSILWWLVFRYFKSVVCLSAPWFLYGIAFIFIGSAHFESNSFTRGWIQNVGSGFYAAASSSGSFFFALNFGDEGGAPVETWIFRACLIQGIQSAYVIALWYWGSTLSQAQSEGLLTPTNNISNSWKISAICYPIAAALFGIGLLLTFGLPNYYRQTPGKVASFYKSVFRRKIVLWNFVAVILQNFFLSAPYGRNWQFLWTSHHAHHWQIVILCVVFYGFVWAGFLFVVSRYFKSHSWFLPVFACGLGAPRWAQIWWGVSGIGYYLPWVTGGYTGGALVSRSVWLWLGVLDSIQGLGFGIILLQTLTRMHMLFCLVCSQVLGSIATICARAFAPNNVGPGPVSPDPTFGGSAVANAWFWVALFCQLLVCAGYILFFRKEQLSKP

SEQ ID NO: 4 - DNA, 7721 bp, Aspergillus oryzae
atgaagtgggctttctccagtgcggtgctggcgcttttcgcaacaacagtaaaagcctggccttacgaagaatctctctccgcatacaaccttaacgaaaacaaatccgcgaccaacccggctcaatattggggagaatggccggaccacaaggggaaatacttcccttctcccgacaattggcgatttcccgtctatactctgttcatggaccgctttgtcaacggagaccctacgaacgacaacatcaatggaaccctcttcgagcacgatatctcctcgacacaaatgcgccatggtggagatgtggctggtctagtggatactttggattatcttcagggaatgggtatcaaggttcgtcattcgttcaggttaattacgtggcatgccatactgagaattcttaggccatctatctcgcaggaaccatcttgatgaaccagccatggggctctgatggttattccgctctcgatacgacactgctcgatcaacatttcggtgacattgcgacatggcgtaatgctatcgacgagattcataagcgcgggatgtatgtcatcttcgataacacgattgctacgtaagtctcgccgcatccacggtacatatgagatgattgttaacgcttgtattcaggatgggtgatctcatcggcttcgagggccatctgaatgataccaccccgttttcggttaaggagcataaagcactttggaagagcaatcgtcgctatgtggatttcgatataggaaacgactataaccagacatgcgactacccccgtttctggtacgaggacggttatccagttcaacagtctatgactgaaggccttgttggttgttatgacagcgactttgatcaatatggtgatattgaggctttcggcgtgttccctgattggcaacgtcagctagcaaaattcgcctccgtccaagatcgtctgcgagaatggcacccctcggtccgggagcggttgattcgtcattcctgtatgattatttaccagttggatatcgacggtttccgttatgataaggctactcagtcgaccgtggatgcgctaggagatatgtcgatggcttatcgcgaatgcgcccgtgccgttggcaaggagaatttcttcatctccggtgaaattactggtggtaacacttttggttccatctatttgggccgaggtagacagccgaaccagtatcctgagacggcggagaaggccatgaaaatgaccaacgagtccgagtcgcaatacttcctgcgtgaagctggacatgaggcgatcgacggtgcggccttccactattcgacatatcgtgccctgactcggttcttgggtatggacggtaacttggccgccggttacgatgtacctgtggattgggtcgatgcgtggaatctgatgttgcagtcgaacgacttcatcaaccctaacacaggcaagtttgatccccgccatatgttcggcgcgaccaaccaggatgttttccgctggccgacagtcgaaaagggtgtggaaagacagttgcttgggctgtatatcactaccttacttcttccgggtattcccctcctcctttggggcgaggaacaggcattctatatcttggatgcgacggcatctaactatatctatggccgtcaagcaatgtcccccgcgactgcgtggagagaccacggttgcttttccttggattcctcacagtattaccagtggcctattcaggccggtcgtgagggttgccatgacccaactgctgcgtacgatcatcgtgatccggcccacccggtgcgcaacattatcaagcacatgtaccagctgcgcgaagacttccctgttctgaatgatggctactccgtccagaaactctcgaacctgaccgaggaggtcttctatccgggttccaacggtaccgctacagaaacgggtttgtggtctatcctacgtgatgtcaatgccgatgtgcaggacctaggctccgacgcgaagaatcaaccggtgtggctcgtctaccacaacaccaaccgtacaattgacttcaagttcaactgcaaggacaacgagactgcactaatctcgcccttcgccaccggcaccaaagttcgaaatctgttctatccctatgacgagcacaccttgattgatggccccgtcaagcttggactgaacggatctaccgagctcaatggctgcctggccaacatgacattggacgcctatgagttccgcgcctacgtccccagtgcacgtttcactaagcctcgtccaatgatcacccaattcactcccggccatgacgtccctgttcgctccacggtggctcccaatctggatgaaagcgtgaagattgagctctatttctccgaagagatggactgcgattctgtgaccaaagcgatttccatcagctcatctacggaatctaaaaaggtcccgacgctggatgagaagactgtagactgcaagggaattccagcaagcaacacctcctggactgggcagcttcctagcgtcttcatgtgggctgccaacctgacgggagtgtataacggcatccaccgagtcacggttaagaacgctagcagtactaatggaaacgcgacaacaaacgcggtcgaccacttcctcttccgtatcggacaaatcgataaccccatggtctttacatcggccaactattcgactagtttgctccacgaggaatcgaatggcaccctattcatccagcaccacgcagctggtgctgataagtggcgttattccaccaattggggcaccactttctccgagtggaaggattacacaggtggtaatgacactatcacggagttagaatggtctggaaccaagaaacagagatggaagggacaccatgtgcgggtcgagtactggagcaaatggaccggtagcagcgattacgttcaggagggcgatgctggagtgcattcgaatgtgccacgccgcttcccccatatcttcttcaacggcccttacaatcagtacggatatgacggtggtcttgataacgtggtgaggcaggactccaaagacggactctggaaatatcacttcacggcggagtggccggctcaagcccagctgaacatctggggcatgaatccggatggaaagcctgatcaaagctgggtgctgggtgatgccgataatgattccgttctggatcgaatgccaccctcctctctctctgcaaccttgattaacatcaccgagcatccgcctaagccatatctggcttggaatatctacatcaacgatgcgaccatgaagttccagctcttccctgttgggcaccagaacacgcagatcgccatgttcgtgctcttctggatcatccctgtcatcaccggtgcagcatgcgtctacattttcatgaagtctttctataaggtcaagttcaaccaaatcggtgtgagtgaaaaagccacattgatcccgttggccttgcggagaaagttcaagaggaatcgtggtggtgatgaggaaaggatgaaccccttgatgcgtctggccaacaagtccggtttcctgcagaccaacaccgctattggcggcgctgcttctggcaagcgacgcatggttcttatcgcgacaatggagtatgatatcgaggattggcagattaagatcaagattggtggtcttggtgtcatggcccagcttatggggaaaactctcggacatcaggacctgatctgggttgttccctgtgtcgggggagtcgaatacccagtggataaacccgctgagcccatgaatgtcacgattcttggcaactcttatgaggttcaggtccagtaccatgtcttgaacaatatcacctacgttctactagacgcccctgtgttccgccagcaatcgaagtccgaaccctatccagcccgtatggatgacctcaacagtgctatctactactctgcctggaatcagtgtatcgctgaggcctgcaagcggttcccgattgacctgtaccatatcaacgattatcacggttctctagctccgctctaccttcttcccgatacagtaccggcttgtctttcccttcacaacgctgaattccagggtctctggccaatgcgtacacagaaagaaaaggaggaggtgtgctccgtctttaacctagatattgatattgtcagacgttatgtgcagttcggtgaggttttcaacttgctgcactcaggtgctagttatcttcgtgttcaccagcagggtttcggtgccgtcggtgtgtccaagaagtacggaaagcggtcctacgcccgttatcccatcttctggggtttgaggaaggtcggcaacttgcctaaccctgatccttcggatgtgggagaatggagtaaggaaaaggctattggtaacgctgacgaggtccatgtggatcccgactatgaggccggcagggcagacctcaaacgccaggctcaggaatgggctggtcttgatgtcaaccctgacgctgatctaatggtgttcgttggtcgttggtccatgcagaaaggtgtcgatttaatcgccgatgtgatgccagctgttcttgaagctcgccctaacgtgcaggtaatctgtgttggacctgttatcgatctttatggtaaattcgctgccctgaagttggaccacatgatgaaggtttaccctggacgtgtgttctcgagacctgaattcaccgctcttccgccttatatcttctctggtgctgaattcgcgcttattccttctcgtgacgagccctttggtctagtcgcagtcgagttcggccgtaagggagccttgggtatcggtgcccgtgtcggtggtctcggtcagatgcctggatggtggtataacgtcgaatctactgcgacatctcatcttctgtaccagttcaagcttgccatcgacgccgcacttaactcgaaacaagagaccagagccatgatgcgtgcccgttctgctaaacagcgattccccgtcgcccaatgggtcgaggacttggaaatcctgcaaaccaccgcaatccaagtacacaacaaggaattggtcaagcacaacggtcgtccgttcactccgactggaacgactactcctagtggccttatgactcaacctgcgagccctctcgggaccccaggaatgcaaactcctcttgctcattctagggaaagcagctactcgaacctcaaccgtctaagtgaatacgttacccagccaaagaccagctacagcagagatcccagccctagcggcacggagaagccgaaatcaggacttcagcgacagctttcccttggtgttcgctctggacctggtcatcagagccgtcgtggtcgcgctcgccagcgtgacagcatcccagaacacgaagacacccaggaagctcacggtggcgccattactgatgttgaggaagaaagcagtgacgacgacattgtcaaccattacgcggatgacgagtatactcttacacctgcccaagtcgaagaaggccgtaggttacaggccgcccagcaacaggctggtgtgcgcatgccgttgagtccaggtggtagacgctacagccaagactcgttgcatccgagaaatgtccagcctccttcgagtcccggaacacccccagccgcttcccagagtctccttcctccccctaggctcctcgatcccggcagtcgtctcagtagcgcatccgttctctcacttgactccgttgtcggtggcaagaaggacttcaagctgcaaaaggttgatccgttcttcactgatagcaccggcgagtattacaagatctttgataagaagcttgatgaactcaatggatcgaactcggagtcgcaactgtgtatcgaagaatacttgatcaagagtgaaaaggaatggttcgacaagttccgtgacgctagacttggtcgcactaaatcgccaactccctcagtctatcgtgataagcacggcgcttcccctatcggctcgttctacgatgataacggctcccgtatgagtggtagcgatggccctcactccaatgacagtgaagacgacgagttcctcctcggaaaggactatgtccctcccaccggtctcaagaagtggatgcagattcgcatcggtgactggcctatctactccttgttcctcgctttaggccaaatcattgctgccaactcgtaccagatcacattgctcacgggcgaagtcggtcaaactgccgagaaactgtacggaattgcaaccacgtatttgatcacgtctattctctggtggcttgtgttccgctacttcaaatccgtcgtctgtctgtctgcgccatggttcttgtacggtatcgccttcatcttcattggatccgcccattttgagagcaactctttcactcggggatggattcaaaatgtcggtagtgggttctacgccgcggcctcgtctagtggttctttcttcttcgcgctaaacttcggtgatgaaggtggtgcacctgtggaaacatggatcttccgtgcatgtctcattcagggtatccagtccgcctatgttattgctctctggtactggggttcaaccctgtcacaggcacaaagtgagggtctcttgactcctacaaacaatatctccaattcttggaagattaggtaggttatattgatctctttggttaatttcactagctaactaatactttcacagtgccatctgttaccccattgccgcggcccttttcggaattggtttgctcttgacattcggcctgcccaactattaccgtcaaacccctggcaaggtcgcttccttctacaaatccgtgttccgtcgtaagatcgtcctctggaactttgtcgcggtcatccttcagaacttcttcctcagcgccccctacggccgcaactggcagtgtaagttgacccctgtataacggtttccatcatatcagaccaaactaactgtgtctctttgcagtcctctggacatcccaccacgcacatcactggcaaatcgtcatcctctgtgttgttttctacggcttcgtatgggcaggcttcctattcgtcgtcagtcgctacttcaaatcacacagctggttcctccccgtgttcgcctgtggcctcggagctccccgctgggcacaaatctggtggggtgtgtctggcattggctactacctcccttgggtgacaggaggatataccggcggcgcgctcgtctcccgaagtgtctggctctggctcggcgtgctggactcgatccagggtctcggcttcggtatcatcctcttgcaaaccctgactcgcatgcacatgcttttctgtcttgtttgttctcaagtccttggttctatcgctacgatctgcgcgagagccttcgcccctaataatgtgggcccagggccggtttcgcctgatcctacctttggtgggagtgcggttgcgaatgcctggttctgggttgctctgttttgtcagttgttggtctggtaagttattcacatcttatgaactttgttatatacaacgatcgctaacgtgtgatgattacagtgccggttacatcctcttcttccggaaagaacagctgtcaaagccttaagggccatgcttaactgtgtggtgtttgttatgattactaccgtgaatgtatacatagtccagctctctggacgttactgtctatcttaatataatcctttgtatatagatgaccataatctgaacatattcagatc

SEQ ID NO: 5 - protein, 2387 aa, Aspergillus oryzae
MFLTVMQRSAILILSLLSATALSWPYTESLVDYNLNENKTAEAPIDYWGEWPDHEYHPSPDNWRFPIYTIFLDRIANGDPKNDDINGTAFEHVVGSNQMRHGGDLVGLIDTLDYIRGMGFKGIYFAGTYLMNLPWAYDGYSPVDTTLLDMHHGTLEDWRRTITEIHKRDMYVIVDNTLATMSNLIGFKGHLNDSADFRADEYEVQWISDRQYADFKFGNEYNETCNFPKFWNETGYPLTSGGVEELKGCYNSDFDQFGELEAFGNFPDWKRQLTKFASVQDRLREWHKPIRDVITKHSCIQIASLDIDGFRFDKAVQTTLEPLSEITAVYRECAKKYGKHNFFLPGEITSGNTFGSLYLGRGRQPDQQPESADAGVKLKNSSDGYFLRDDGYQALDSAAFHYTIYRSMTRFLGMDGNLVAGFDLPTDFIEAWNGMLVSNDFLNAYTGEVDPRHMFGVSNQDNFRWPAIVNGTEKYLLGLYIVTLELPGIPLILWGEEQAMYVFESTASNYLFGRQPMTYQTAWWTHGCMTLNTSKFYDFPNEKGLHGCEDITVTYDQRNPAHPLRNIMKRMFEIREQYPVANDGFYLQTLSQLTKDVYLPGSTDTPTVTGLWSVLRSYFPGVQKEASKNSQNLWLKDTALLSPFKSGTKLKNLFYPYDELTLEDGPGEIAVHNSTESYGCIRSMKLLPWEYRAYIEAENFVEPGPTVTEFVPGHDARLLSTDDSGQTVDIQLGYSKEMDCDKIADAISLNSTTVKGVTASLDTSSVSCNKISPRTSSDNFVGEVPTVWTWSAKLKNVHHGIHQLTVKNVSTTSGVHTDAVDQFLFRVGSQNNPLLSPLSNYSTSLVQKSDNGSFYIQHDAAGADKFRYSTDFGLNWSNWTTYTGDNTLVDFPEWTGTDAQKWKGTHIRVQYFSRLTGSSDYIQEGDHGWEKGVARRFPNLFWNGPFNQYGYDAGLDNKMRYDTKDHRWKYDFVYEWPAIGQMSVWGMLKDGRPDVTEVYGDVDNSSVVQKLPPSYLSSNVINITKLPPFPHLGWTITLNDANLRYEMLPVGSGWAQLVLYILLWVLPILMGFAGIFIFIRTFYRVKLNTDGDVAKEDKLPLLFWRRVREKFSGDDESDKSISDKDIPTDIAIAGAPEQRRTVLIATMEYNIEDWKVKVKIGGLGVMAQLMSQHLKHQNLIWVVPCVGDIEYPQDTPSEPFVVTILDKPYFINVQYHIVDNITYVLLDAPVFRQQTKAEPYPPRMDDLDSAIYYSAWNQCIAETIKRFPSIDLYHINDFHGCLAPLYLLPTRTIPVCLSLHNAEFQGLWPLRNPQEKKEVCSVFNLPIETATKYSQFGNVFNLLHTGASYVRFYQRGFGAVGVSKKYGKRSWARYPIFWSLEKIGSLPNPDPSDTGDMTNNADAEVPIQSYEERINDKLQAQKWAGLNEDRDADLLVFVGRWSKQKGVDLIADVMPAILSARPHVQLICVGPIVDLYGRLAATKLERIMEMFPGRVFSKPEFTVLPPYVFSGADFALIPSRDEPFGLVAVEFGRKGALGIGSRIGGLGQMPGWWYTVESDATRHLLHQLKTAIKQALDSSQDAREEMRANSVRQHFPVLEWIQKLEALQRTAIQIHHTKNKNTVTGPMPESQNYWETQSVRMSTLGLPGPTQSVTEGLDTPPGRLLTPGQSRFAELQLEGADGNRNSSLGRKLSLGRRSGPGQDRKRPGKSPPRESQILGEDLEGENTDAEEEGTTTPQVNYISPEEAMAAVNNTLGTQDIGMAHTNNSTHSLAGPQGSTYMSVPGSPNNMSRASSPMPGTPGLPQYPFQFALGSGGNTPFTHSRNVSMLSLPSVVADHNQPVFELQKVDPTFTDSTRHFTRRFEEILNNLNKKNSMTDCCIETYLMKSERKFYDMYNDAQLKKQPDDRAVSDSNSDTQDNRASYATVTGGSDSNDPDEIDLWLSRLGYKRPIAIQRFMRRRLGKWPVYALFLGLGQIIATNSAQMTLLVGQVGETATKLYIIATIYCISSICWWLLFYRFPSVIVLTLPWFIYCMAFIIIGVSPFALTSLGRAWAQNVAAGVYSAASSSGSLFFALNFGDQGAVPIKDWMFRASLIQGIQQLYTVALWYWSSKVTEAEVGGVSTAALSSWRLTAVVMPIAAVCFIVGVLLALGLPKYYRQSPGRILFFYTSLFRRRIVLWFFFMVIVQNWFLSAAFGRNWSFLWSSQHAKAWEVVILVIFFFVVLWVIILIIFRALSKEHSWILPVFGLSLGAPRWAQTWWGTSNIGYYLPWAGSLTSGALVSRCVWLWLGVLDEIQQVGLGMILLQTLTRVHVCFVLLAAQALGSIATICARGFAPNKLGPAGISPNVGTSLDTVGNAWFWIALFFQLLASWGFLLFYRREQLNRP

SEQ ID NO: 6 - DNA, 7369 bp, Aspergillus oryzae
atgttcctcacggtgatgcagcgctcagcgatccttatcctgtcgttactgagcgctaccgccttaagctggccatacactgagtcgctcgttgactataacctgaatgaaaataaaaccgccgaagcgccgattgattattggggagagtggccggatcatgaatatcacccgtcgcccgataactggcgctttccgatctataccatctttttggaccgcatcgctaacggtgacccgaagaatgatgatatcaatggcaccgcctttgagcatgtggttggctcgaatcaaatgcgccacgggggcgatttggttggtctaattgatacgctggattatattaggggcatgggtttcaaggtgtgttgagccgattgtgatccgatcttggtgcttactctggtagggcatttacttcgctggaacgtacttgatgaaccttccctgggcctacgatggctactcaccggttgataccactttgctcgacatgcaccatggcacactcgaggattggagacggaccatcactgagatccacaaacgagatatgtatgtgatcgtggataatacactggcaacgtaagtacatatcccaggtgtctcagatcaacactggttgacgagtatatgcagaatgagcaaccttattggtttcaaaggacatctcaacgattcagccgattttcgagcagatgaatatgaagtgcagtggatctcagatagacagtacgcggacttcaaattcggaaatgagtacaacgagacctgcaacttcccgaagttttggaatgagactgggtatccgttgacatcaggtggtgttgaggagctgaaagggtgctataatagcgatttcgatcaatttggagagctggaggcgttcggtaactttccagactggaagcgccagcttaccaagttcgcctcggtgcaagatcgtctgcgtgaatggcacaagcctattcgtgatgtcatcactaagcattcttgcattcagatcgctagtctagatatcgatggtttccgtttcgataaagccgttcagacaaccctcgagcccctaagtgaaataaccgccgtctaccgtgagtgtgcgaagaaatatggcaagcataactttttccttcccggtgagatcacatcaggaaatacctttggcagtctttaccttggacgcggtcgtcagccagatcagcagcctgaatctgcagatgctggtgttaagttgaagaatagttcggacggatattttctcagagacgatggataccaggcgttggactcagccgcgtttcactacacgatctaccgttcgatgactcgtttcctgggaatggatggtaatctagtggctggctttgacttgcctactgattttatcgaggcctggaatgggatgctcgtcagcaacgacttcctcaatgcatacacgggtgaagtagacccgaggcacatgtttggtgtctcaaaccaggacaactttcgctggccagcaatcgtaaatggcaccgagaaatatcttctgggtctttatatcgtcaccttggagctccctggaattcctctgatcctatggggcgaagagcaggcgatgtatgtttttgaatctactgcttctaactacctgttcggccggcagccaatgacgtatcagacggcatggtggacacatggatgcatgactttgaatacatccaaattctacgatttccctaatgagaagggactacacggctgcgaggatatcaccgttacgtatgatcagcggaatccggcacaccctctgcgcaatatcatgaagcgcatgttcgaaattcgggagcagtatccggtagcaaatgatgggttttatcttcaaacgctttctcagctgacaaaggatgtgtaccttcctggttcaacggacacgccgactgtgactggtctatggtcggttctgcggagctacttcccaggcgtccagaaggaggcaagcaagaacagtcagaacctttggcttgtgtatcataatgctaacaaaactgaaacctacggtggtgactgcaaaaagaaagataccgccttgctgtcgcctttcaagtcgggaactaagctgaagaatctcttctatccgtacgatgagctcactttagaagatggtccgggcgaaatcgcagtccacaatagcactgagagctatggatgcatccgcagtatgaaattgcttccatgggaataccgtgcctacatagaggccgagaacttcgttgagcccggccctactgttactgagttcgttcctggccacgacgcccgattgttgtctacggatgacagtggccaaactgtcgacatccagctcggatattcaaaagagatggactgtgacaagatcgccgatgccatctctttgaactcaacgacagtgaagggagttacagcttcccttgacacatctagcgtgtcttgcaacaaaatctccccaaggacaagcagtgataactttgttggggaggttccaaccgtttggacatggtctgccaagctgaaaaatgtccaccacggaatccatcagctgacagttaagaacgtttccacgacgtctggagttcataccgatgcggttgaccagttcttattccgtgtcggaagtcaaaacaatccccttttatccccactgtccaattattccaccagtcttgtgcagaaatccgacaacggcagcttctatatccagcatgacgccgctggtgctgataaatttcgctactcgactgattttggccttaactggtccaactggacaacgtataccggtgacaacaccctagtcgacttcccagagtggaccggaacagacgctcagaagtggaagggaactcatattcgcgtacagtacttttcaaggctcaccggcagtagtgattacattcaggaaggtgatcatggctgggaaaaaggtgttgctcgaagatttcctaacctcttttggaacggtccgttcaatcaatatggttacgatgcgggactggataacaagatgagatacgataccaaggatcatcgttggaagtacgattttgtctacgagtggccggccattggacaaatgagtgtctggggaatgttaaaggatgggcggcccgacgttacagaggtgtatggtgatgtcgacaactcatctgtagttcagaaacttcctccgtcttacctatcgtccaacgtgatcaatatcacaaagctgcctccattcccgcacctcggctggaccatcacgctcaatgacgccaacttgagatatgagatgcttccggtcggatctggatgggcccagctcgtgctatacattcttctctgggtgcttccaattctcatgggatttgctggtatcttcatcttcatcaggacattctaccgtgttaaactcaataccgatggcgatgtggccaaagaagataagctaccgctcctgttttggcggagggtcagagaaaagttctccggcgacgacgagtcggataagtcgatatcagataaggatataccgacagacattgctatcgcgggagcccctgagcaacgtcgtacagtattgatcgccaccatggaatacaacatcgaagactggaaggtcaaggtcaagatcggcggtctaggcgtcatggcacaactcatgtctcagcatctgaagcatcaaaacttgatctgggttgttccttgcgttggtgacattgaatatcctcaggacacgccatccgagcctttcgtggtcactatcctggacaagccatattttatcaatgtgcaatatcatatagttgataacatcacctatgtcctgctcgacgctccagttttccgccaacagaccaaagcagagccatatcctcctcgcatggatgatcttgacagtgcaatctactattcggcatggaaccaatgtatcgcagagacgatcaaacgattcccgtcaatcgatctctatcatatcaacgatttccatggttgtttagcaccactgtatttgcttcccacgcgtaccatcccggtgtgcctgtccttacataatgctgaattccagggtctttggcccctgagaaacccccaggaaaagaaggaagtctgttcggtcttcaaccttcccatcgaaactgcaaccaagtacagtcaatttggaaacgtcttcaaccttcttcacactggtgcgagctatgtgcgattctaccaacgcggtttcggcgcagtaggtgtgtccaaaaagtatggaaagcgctcatgggctagatacccgattttctggagtcttgaaaagattggcagtcttccaaacccagacccctccgacacaggggacatgacaaataacgcagacgccgaggttccaatccagtcctacgaagaacgaatcaatgataagctacaggcccagaagtgggctggtttgaatgaagatcgtgatgctgacctacttgtgttcgtcgggcgatggtcgaagcagaagggagtggatttgattgcagatgtcatgccagcgatattatccgccagaccccacgtgcaattgatctgcgttggacctatcgttgatctctatggtagactggctgctacaaagctagagcgcatcatggaaatgttccctggtcgcgtcttctctaagccagagttcaccgttttgcctccatacgtattttctggtgccgacttcgctctgattccctccagagacgaaccatttgggttagtcgctgtagagttcggccgtaagggtgcactgggaatcggttctcgcattggaggtttaggccagatgccaggttggtggtacaccgtggaatccgacgcaacccgccatcttctgcatcagttgaagaccgctatcaaacaagcgttggactcatcacaggacgctcgtgaggagatgcgcgccaattccgtcaggcaacatttccccgttcttgaatggattcagaaactcgaagccttgcaacgaacagcgatccaaatccatcacaccaagaacaagaacaccgtgacaggcccgatgccagagtcgcagaactattgggagactcaaagcgtacgaatgtctacgctgggccttccaggacctacccagtcggtgacagagggtttggatacaccgccaggaaggcttttgacgcccggccagtctcgatttgcagaattgcaattggagggagctgatggcaacaggaacagcagcctgggtcgcaaactctcgctcggtcggcgatctggacctggtcaggacagaaaacgtcccggcaagagcccgccgcgcgagagccagatcctaggagaggatttggaaggtgagaacacggatgccgaagaagagggcaccactacgccgcaggtgaactatatttcacctgaagaagctatggctgcagttaacaacactttgggaactcaagatatcggaatggcacacacgaacaatagtactcactcgctcgctggtcctcaaggatctacttacatgtccgtgccaggctcaccaaacaacatgtcacgggcctcctctccaatgccaggaaccccggggctgccccaatacccattccagttcgcattgggttctggcggaaatactcctttcactcactcccgcaatgtgtccatgctttccttgccttcagtcgtggcggaccacaaccagccggtttttgagctgcaaaaggttgatccgacctttacagacagcacacgccacttcacgcgacgcttcgaagagattctcaacaacctgaacaagaagaactcgatgacagactgctgtatcgagacgtacctaatgaagagcgagcgtaaattctacgacatgtacaacgatgcacaattaaagaaacagcccgatgatcgtgcagtgtctgattcgaattcagacactcaagataaccgcgcctcgtacgccactgtcactggaggttcggactcgaatgatccggatgagattgatttatggctctctcgactggggtataaacgaccgattgctattcaaagattcatgagaaggcgtcttggcaaatggcctgtctacgctctattcctgggtcttggacaaatcatcgcgaccaactccgctcaaatgaccctgttggtcggtcaggtaggagaaacagcaaccaagttgtacattatcgccacgatctactgcatttcctctatctgttggtggctcctcttctatcgattcccgtcagtaatcgtcctcactctcccctggttcatttactgcatggcatttatcatcattggcgtctctccattcgctctcacatctctcggtcgagcctgggcccagaacgtcgctgcaggtgtgtattccgccgcatcatctagcggctcgttattcttcgccctcaacttcggtgatcagggtgccgttcctataaaggattggatgttccgcgcaagtctcatccagggaatccagcagctctacaccgtcgccttatggtactggagctcgaaggtgaccgaagcagaggtgggaggcgtgtccaccgcggctctaagctcatggagactcacagctgtggtgatgcccatcgccgcagtatgtttcatagtcggcgtgcttctcgcgctcggcctaccaaaatactaccgccaatcccccggtaggatcctcttcttctacacatccctcttccgccgccgtattgtcctctggttcttcttcatggtaatagtccagaactggttcctctccgcagcatttggtcgcaattggtcattcctctggtcctcccaacacgctaaggcatgggaggtcgtcatcctagtcatctttttcttcgtcgtcctctgggtaatcatcctcatcatattccgcgccctatccaaggaacacagctggattctacccgtatttggtctgagtctcggcgcaccgcgctgggcccaaacatggtggggaacgtccaacataggctactacctgccatgggcgggaagtctgacatccggtgccctcgtgtcgagatgcgtctggctctggctcggtgtgcttgacgaaatccagcaagtcggcctgggtatgatcctcctacagacactgaccagagtccacgtgtgcttcgttctgttggccgcacaggctctcggatccatcgctacgatctgcgcccgtggattcgcgccgaataagctcgggcccgcgggaatctcgccgaacgtgggaacgtctctagatacagttggaaatgcgtggttctggatcgcgctcttcttccagcttctggctaggtaaggcttctgtattcccggcttcaatggattcaatactaatgtggttcatagttggggcttccttttgttctatcgtcgtgagcagcttaataggccttaa

SEQ ID NO: 7 - protein, 2387 aa, Aspergillus nidulans
MRWRPLNPLLPLLAATAAGWPYEESLVDYNLNVNKNAATPADYYAPEWRNHTYMPSPENWRFPFYTLFLDRFVNGDPTNDNINGTVYEHDLNSNQMRHGGDAQGLVDTLDYLQGMGIKGIYLAGTILMNQPWGADGYSILDTTLLDQHFGTIQTWRNAITEIHKRGMYVLFDNTIATMGDLIGFKGYLNVSAPFSVKEHEAVWKSDRRYVDFDFGNTYNQTCEYPRFWNETGWPVDKDVRDELQGCYSSDFDQYGDREAFGVYPDWQRQLAKFASVQDRLREWNPSVRERLIRHSCMIIKALDIDGFRYDKATQATVDALGDMSSAYREITGGNNFGSIYLGRGRQPNQYPDSAMDSMAMNNESDHQYFLREDGLQALDSAAFHYSIYRSLTRFLGLDGNLAAGYDTPIDWTDAWNVMVMTNDMINANTGKFDPRHMFGATNQDVFRWPAIKQGIERQLLAMFITTLHLPGIPILLWGEEQGFYILDATADNYVYGRQAMSPATAWKTHGCFQLTADQYHNWPISKGREGCHDETVTYDHRDPSHPLRNIIKHMYQLRQDYQVLNDGYSVQKLSNQTRQIFYPGSNGTATETGMWSVLRDSVYKIQELHNEQPVWLVYQNDNKTVEYNFDCSDNDTALISPFATKTTVVNLFYPHDEYDLKDGPKKLHLNGSAEFNGCLDSMTLKPFEFKAFVPKERFVKPRPMITKITPGHDQPIISKVVASEAEDLDLSIYFSAEMDCDSVTKAIKVQSTTEVNKTALIDKDSVKCRRIDPNETRWTAQLPSVWAWSSKLTGVYNGIHRLTVTNATSEVGGSTQAVDHFLIRIGQIDNPMVFTTANYSTDLLHQHENGTLYIRHKAAGADKYRYSTNWGSSFSNWREYKGGDEFIEEQPWSGTKKQKWNGKHVRVEYWSKLTGSSSYVQEGDYDTKHQRRFPHLFFNGPYNQYGYDAGLDNEVKQDSDGYWKYRLRAEFPAQGQFNVWGMNPDGKPDQSFVFGDLDSDGVLDRMPPSSLNTLSINVTDRPPSSYLSWNIWVDDGTMSIQFQPTGSRTIQMVVYFLLWFVPLVTAIGCVYAFMKSFYQVKFNQIGISQKRSLFGFSVGRKPSLNPLTRLANKSGFLQSTPVFGTGSSRRRSVLIATMEYDIEDWGIRIKIGGLGVMAQLMGKNLGHQDLIWVVPCAGDVDYPEDQPAEPMFVTVLGNIYEVKVQYHVLNNITYVLLDAPVFRQQSKAEPYPARMDDLDSAIYYSAWNQCIAETIKRFPIDLYHINDYHGSIAPLYLLPQTIPVCLSLHNAEFQGLWPMRTQKERDEVCSVFNIDVDVARRYVQFGEVFNMLHAGASYLRVHQQGFGAVGVSRKYGKRSYARYPIFWGLKKVGNLPNPDPSDTAEWNKELPKESEIQVDQNYEASRAELKRQAQEWAGLEQNPNADLMVFVGRWSMQKGIDLIADVMPAVLEAHPNVQLICVGPVIDLYGKFAALKLDRMMQLYPGRVFSKPEFTALPPYIFSGAEFALIPSRDEPFGLVAVEFGRKGALGIGARVGGLGQMPGWWYNVESTTTAHLLHQFKLAIGCALNSKPQVRARMRARSAKQRFPVAQWVEDLEILQSTAMRIHSKGLAKASVQPYNSGSNTPLGMMTPPIASTGTVTPTGIQTPPLAHSRSGSYSNINRLSAYGPQQRNTIIYSRDPSPGGEDQPRSGIRQLSLGVRAGPGHLMRRGRRRLRRNSHAGTDENASVSMTEESSDDDIIPSFYGEEEYTLTPEQAEEVRRADMTPQQEQNHGSVRDFFTRRHSSQSSILSRSVLSPASSTTFDGDETFVPPAPPFAEPGNRLSSASVLSVDSVVGEKKDYKLQKVDPTFTDSTGEFYKVFERKLEKLNGSNSISQLCIEEYLEKSEKKWFDRFRDARLGRKQSPSSSIFRTKFEGSSPMALVSNDEVGSRASGSEPRMRPDEFCLGNDYVPPSGLKKWMQVRIFDWPIYSFILGLGQIIAANSYQITLLTGEVGQRPEKLYGIATVYLVSSIVWWFLFRFCKSVVVLSLPWLFYGFAFVLIGVAHYEGDSFARAWIQNVGAGVYAAASASGSLFFALNFGDENGAPVKNWVWRACIIQGTQQAYIIGLWYWGTSISQAVTRGVPDVQAHITETWRMTTICMPIAVFLWVLGILVFFGLPNYYRQTPGKVPSFYQSVCRRKIILWNFVVVILQNFFLSAPYGRNWSFLWSSVHAEPWHIGLLVVAFFGVAWVLILCIFARLSKSHSWILPVFACGLGAPRWAQIWWGVSGMGLFLPWAGSYTTGALVSRSLWLWLGILDSLQGLGFGMILLQTLTRMHICFTLLASQVLGSIATICARAFAPNNIGPGPISPDITDGAGAVANAWFWIALFFQLLICSFPIDVMS

SEQ ID NO: 8 - DNA, 7919 bp, Aspergillus nidulans
atgaggtggaggcctttaaacccgttacttccgctgcttgcagcaaccgcagcaggctggccctacgaagagtcattagttgattataatctcaacgtgaacaaaaacgctgccaccccagcagattattacgcaccggaatggaggaaccacacatatatgccgtcgccagagaactggaggtttccattctacaccctgtttctggacagattcgtcaacggcgaccctactaacgataatattaacggaactgtctatgaacatgatttgaactccaaccagatgcgacacggcggtgatgcacaaggcctggtagacacactcgactaccttcaaggaatgggaatcaaggtctgatttttgttttcgtctcagcttcagccttcgctaaccagatcttgtttaggggatctacctcgcgggtactattctcatgaatcaaccctggggcgcagacggttattcgattttggacactacgctgctggatcagcacttcgggaccatccaaacctggagaaatgcaatcacagagattcacaagcgtgggatgtacgtcttattcgacaacactatcgctacgtgagtctgctggttttccaagtcaaatgcgcgaatgctaactacacccaaggatgggcgatttgatcggattcaaaggttatttgaacgttagcgccccgttctctgtcaaagagcacgaagctgtttggaagtctgaccgtcgctacgtcgattttgattttggaaacacctacaatcagacctgcgagtaccctcgattctggaacgagactggctggcccgttgataaagacgttcgtgatgagctacaaggttgctatagtagtgatttcgatcaatacggtgacagggaagctttcggtgtatatccagactggcagcgacagctggccaagtttgcatcagtccaggatcgtctccgtgaatggaacccaagcgttcgcgagagactaatcagacattcctgcatgattatcaaagctcttgacattgacggatttcgctatgacaaagccacgcaggccacagtggacgcccttggagacatgtcgagtgcttatcgtgagtgtgcccgtgaggtcggtaaaaacaactttttcctcccaggtgagattactggtggaaacaatttcggctcgatctatctcggacgaggaagacagcccaaccaatacccagactctgctatggattctatggccatgaacaacgagtcggatcaccaatattttcttcgtgaagatggtttacaggcgctcgatagcgctgccttccactactcaatctatcgatccctcacccggttccttggcctcgacggaaatcttgctgctggttacgatacgccgattgactggacagatgcctggaatgtaatggtgatgaccaatgacatgataaacgcgaataccggtaaatttgacccgcgacacatgtttggtgccacgaaccaggatgtttttcgttggccagccatcaaacagggtatcgaacgccaactcctggcgatgttcattacaacacttcacctcccgggtattccaatattgttgtggggtgaagagcaaggtttctatatcttggacgccactgcagacaactatgtctacggccgccaggcgatgtcaccagccacagcttggaaaacccatggatgcttccaattgacagcagatcagtaccacaactggcctatcagcaaaggacgtgaaggctgtcatgacgagacagtaacctatgaccaccgcgacccgtctcatccgctccgaaatatcatcaaacatatgtaccagttgcgacaagattaccaggttttgaacgacggatattctgtccagaaactctccaatcaaacccgccagattttctatccaggctcgaacggaacggctacggagaccggaatgtggtctgtcttacgagactcagtttacaagatccaggagctacacaacgagcaaccggtttggcttgtataccagaatgacaacaagacggtggaatacaattttgactgcagtgataatgacacggcgttgatatccccctttgccaccaaaaccacggttgtcaatctcttttacccgcatgacgaatatgacttgaaggacggtccaaagaagctccatcttaatggctcagcggagttcaatggatgccttgatagcatgacgctgaagcctttcgaattcaaggctttcgttccgaaagagcgatttgtgaagcctagacccatgattaccaaaatcacaccaggacacgaccaaccgatcatttccaaagtcgtggcgagcgaggcagaggatcttgatttgagcatttacttctctgcggagatggactgcgactcagtcacaaaagcgatcaaagtgcagtccaccacagaagtcaataagacagctttgattgacaaagacagcgtgaaatgcaggaggattgatccaaacgaaacgcggtggactgcccagctacccagcgtctgggcgtggtcgtcaaagttgaccggagtatacaatggaattcatcggctgaccgtcaccaatgccaccagcgaggttggaggctcaacacaggctgttgatcactttctcattcgcattggtcaaatagacaatcccatggtcttcaccacggccaattactccactgacctacttcaccagcacgagaacggaacactctatattcgacacaaagccgctggtgctgataaatatcgttattccaccaattggggaagctctttttcaaactggcgcgaatacaaaggtggcgacgaattcattgaagaacaaccatggtccggaactaaaaagcagaaatggaatgggaagcatgtccgcgttgagtactggagcaagttgactggtagcagcagctatgtccaagaaggtgactatgataccaagcatcaaagacgcttcccgcacctcttcttcaatgggccttacaaccagtatggatacgatgcaggactggacaatgaggtgaaacaggacagtgacgggtactggaaatatcggctccgagcggaattccctgctcagggacagtttaatgtttggggtatgaacccagacgggaagcccgaccagagttttgtgtttggtgatcttgattctgacggtgttttggaccgcatgccaccatcctccctgaacaccctttctattaacgtcaccgacaggccaccgtcgtcctatctatcttggaatatttgggtcgatgacggtaccatgagcatccagtttcaaccgactggctcgaggacaatccagatggtagtttatttcttgctttggttcgtaccgcttgtgacagctatcggatgcgtatatgctttcatgaaatcgttttaccaggtcaaattcaaccagattggaatcagccagaagcggtcattattcggtttctcagtcggccggaagccttcattgaatccactgacgcggcttgccaataaatccggatttctccaaagcacgcctgtctttggaacagggtcttctcgcaggcgcagtgttctcatcgccactatggagtatgacattgaggactggggtatcaggattaaaattggtggtcttggagtcatggcacagctcatgggcaagaacctcgggcatcaagatctcatttgggttgtcccatgtgcgggggacgtagactacccagaggatcagccagctgagccaatgtttgtgactgttctcgggaacatctacgaagtcaaggttcagtatcatgtcctgaacaatattacatatgttcttctcgatgcgcccgttttccgtcaacagtcaaaggctgagccctaccctgctcgcatggacgaccttgatagtgcgatatactattccgcctggaatcagtgcattgctgagaccatcaagcgcttccctatcgacctttatcatatcaatgattatcatggttctattgcgcctctctaccttcttccccagacgatccctgtttgtctttcgcttcacaacgccgaatttcagggtctctggcccatgcgcacacaaaaggaaagggatgaggtttgctctgttttcaatatcgacgtcgatgtcgccaggcgatatgtccaatttggcgaagtttttaacatgctccatgccggtgctagctaccttcgtgtccaccaacaagggttcggcgctgtaggtgtttccaggaaatatggaaaacgctcgtacgcgcgctatcccatcttctggggtctcaagaaggttgggaatcttccgaacccagatccttctgacacggctgaatggaacaaggaactgcctaaagaaagtgagatccaggtagaccagaactacgaggcaagcagggcagagctgaaacggcaagcgcaggaatgggcgggccttgaacaaaaccctaatgctgaccttatggttttcgtgggacggtggtcgatgcagaaaggaatcgatctgatagctgatgttatgcccgctgttttggaggctcatcccaatgttcagctgatctgtgtcggcccagtcattgacctttatggaaaatttgccgccctgaagcttgaccggatgatgcagctctaccctgggcgtgtgttctcaaagcccgagtttacagcacttcctccatacatattttcaggagcggagtttgccttgatcccatcccgtgacgaaccgttcggactggttgccgttgaatttggtcgcaagggagccttgggaatcggtgcacgtgttggagggcttggccagatgccgggttggtggtataatgttgaatcaacaactactgcccatctgcttcatcaatttaaactagctatcggatgtgccttgaactcgaaaccccaagttagggcaaggatgcgtgcaagatctgcaaagcagcgtttccctgttgctcaatgggttgaggacctcgagattctacagtcaacggccatgcgaatccacagcaaaggcttggctaaggcgagcgtccagccctataactcaggaagcaacaccccacttggcatgatgacgccccctattgcgtcgactgggactgttaccccgacgggaatccagacacctcctcttgcccattcgcgatcaggaagctactcaaacatcaaccgcctcagtgcttatgggcctcagcaacgtaacacgataatctacagccgagacccaagcccaggcggcgaagaccagcctagatctggtattcgacagttatcacttggtgttagggctgggcctggacatcttatgcgtcgtggccgccgcaggttgagaagaaatagccacgcggggacggacgagaacgccagcgtctccatgacggaggagagtagcgacgacgatataatcccaagtttctacggggaagaggagtacacgcttacccctgaacaggctgaggaagtacgtcgcgcagatatgacaccacagcaggaacagaatcatggctcggttagggacttctttacccgtcgtcactcgagtcagagctcgattttgtctcgtagtgttttgtctccagccagttcgactacgtttgacggggacgagaccttcgttccacccgcaccaccgtttgcagaacctggaaaccgtctcagcagtgcgtcggtactctctgttgactcagtagtgggcgagaagaaagattacaaactgcaaaaagttgatcctacatttaccgatagcactggcgaattctacaaggtttttgaaagaaaactagaaaagctcaatggctcgaactccatctcccaactttgcatcgaggaatatctggagaagagcgaaaagaaatggtttgaccgattccgtgatgcacgacttggccgcaaacagtccccgtcgtcttccattttccgcaccaagtttgaaggctcctcgcctatggcactcgtatcaaacgatgaagtcggatcgcgcgcgagtggaagcgagccccgtatgaggcctgacgaattttgtcttggaaacgactatgttcctccctctgggctcaagaagtggatgcaagttcggattttcgactggcccatttactccttcattctcggactgggccaaattatagcagcgaactcttaccagatcaccttgttgactggagaagtcggccagcggcctgagaagctctatggtattgcaacagtatacctcgtgagctctatagtctggtggtttcttttccgcttttgcaaatctgtcgtggtactgtctctgccctggctgttctacggtttcgcctttgttcttattggagtcgcacactatgagggcgatagcttcgctcgtgcttggatccagaacgttggagccggtgtatacgccgctgcatcagccagtggctcattgtttttcgcccttaacttcggagacgaaaacggtgcaccagtcaagaattgggtgtggcgtgcttgcatcatacaaggtacccagcaagcctacatcatcggtctttggtactgggggacttctatatcgcaagcagtcaccagaggcgttccggatgttcaagcccatatcacggagacatggagaatgacgtacgtgcctccatactctccaacggtcctttactaactctatattgcagtactatctgtatgccgatagcagtctttctctgggtactcggcatccttgtcttctttggcctaccaaactattaccgccagacgcctggaaaagtcccttcgttctaccaatctgtctgccgtcggaagatcatcctctggaacttcgtagtggtcattctgcaaaatttcttcctcagcgccccctacggacgaaactggagctgtaagtcccaaaaaaatcactttattgttccgaaactaaactaaggaaacagtcctctggagctccgtccacgcggaaccctggcacatcggccttctggtcgtcgccttcttcggagtcgcctgggttctcatcctctgtatcttcgcccggctttccaaatcccacagttggatcctccccgtttttgcctgcggtcttggtgccccgcgatgggcacagatctggtggggggtctcgggaatgggcttattcctcccttgggcaggaagctacacgaccggcgcactagtatctcgctctctctggctatggctgggtattctcgactccctgcaaggcttaggctttggtatgattctattacaaacactcacacggatgcatatctgcttcacgcttttggcgagtcaagtcctaggctctattgcgacgatctgcgccagggcttttgcgccgaataatatcgggccagggcccatctctcctgatattacggatggagcgggcgccgttgcaaacgcgtggttctggattgcgttgttcttccagttgttgatttggtatgtcttcctactatataattggagcctagtgggacgtaaactaatagttcgatctagtgctgggttcctcatgttcttccggaaagagcagcttacgaaaccctaaataccatcgcaactcgacctcgccattgccattaccctggttactttgtcaattcttgacataatcactacagccggtaatctacccggtggcgccccattgcctgacaatcttgctctcgaatctctccattgtcccatcagcctatttactctaccctttattgatcttgctgtccatcgacagaccgtgcatatttgcaacttcttgacgatatttgacctcacctcttgaacgaaaagaatgactgctatgagtcaacctaatgattggatgttatatggtctcttattcttctatggaactgacttatcattgtgcccgccatgacgtgatttgatgtgggtgagatgtgggtgatatgtacctaatgatactactttgttgattagttccttccctattgatgttatgtcataa

SEQ ID NO: 9 - protein, 2444 aa, Aspergillus nidulans
MGRLQLSSGLKAIALLTFAATATCWPYDESLVDYNVNTNKSATNPADYWGEWSDHKYHPSPENWRFPFYTLFMDRFVNGDPTNDNINGTTFEHDLNSNQMRHGGDVAGLVDTLDYLQGMGIKGLYLAGTPLMNQPWGSDGYSALDTTLLDQHFGTIQVWRDAITEIHKRGMYVLFDNTIATLGDLIGFEGHLNDTTPFSEKEHKALWKSNRRYVDFDIGNTYNATCDYPRFWYEDGMPVNESLTAGLVGCYDSDFDQYGDIEAFGVWPDWKRQLAKFASVQDRLREWYPPVRERLIRHTCMIIASFDIDGIRYDKATQATVDALGDMSKAYRECARAVGKENFFIAGEITGGNTFGSIYLGRGRQSNQVDSVGNIYDAMKLTNESDPQLFLREVGHEAIDAGAFHYSTYRALTRFLGMDGQLEAGYDVPLDWVQAWGNMTVTNDLINANTGKFDPRHMYGVTNQDVFRWPAIEWGVERQMLGSFITTLMLPGIPLLLWGEEQAFYVLDATASNYIYGRQAMSSATAWKTHGCFSLESSQYYQWPLVAALDGCNDETVTYDHRDPSHPVRNIIKHMYQMREQYPMLNDGFIIETLSNQTEPVYYPGSNGTETETGMWSVRRDRNEETQDFGSSDDNEPIWLVYSNMNRTHDYTFDCSDNETALIAAFPSGTKVRNLFHPYDTLTLGDGPKEMVYGNSTELVGCLPNLTLSRYEFRAYVKNELWKKPRPMITKFQPGDDEANGHDSPLRSTVAPDASETVRLTLQFSEAMGCDSVTDSISFNSSTETGKIPSIDASTVQCGNITEVANSNATGHIPGKWQWAADLRGVYNGIHRVTVNNASNADGDDSTHAVDHFLFRIGQIDNPMVFTSANYSSSLLHEKEDGTFYIQHHAAGADKYRYSTNWGTTFSDWKTYKGGNDTITMLPWNGTKAQEWEGHHIRVEYWSRWTGSSSHVQEGDSGWKYKTPRRFPHAFFNGPYNQYGYDGGLDNQIKLDAGAGGDGYWKYHFTSEWPAVGQVNVWGINPDGEPDQSWVMGDVDGDKVLDRMPPSALSATLINITDHPTHPYISWKLYINDATMRYYLIPAGHQSGQIAMFVLFWIIPLLSGSACVYIFMKSFYKVKFNEIGAAGASTEMKSLVPLALRRRMKQLASGNGKNGPSFNPLMRLAEKSGFMQSTTALAGAASGKRRMVLIATMEYDIEDWGIKIKIGGLGVMAQLMGKTLGHQDLIWVVPCVGGVDYPVDTPAEPMTVTILGQAYQVNVQYHVLKNITYVLLDAPVFRQQTKSEPYPARMDDLDSAVYYSAWNQCIAEAIKRFPVDLYHINDYHGSVAPLYLLPGTIPACLSLHNAEFQGLWPMRTQKEKEEVCSVFNLDVEVVRNYVQFGEVFNLLHAGASYLRVHQQGFGAVGVSKKYGKRSYARYPIFWGLRKIGNLPNPDPSDVGEWTKEDSLIKDEDIKVDPEFEAGRAELKRQAQEWAGLDQNPDADLLVFVGRWSMQKGVDLIADVMPAVLEARPNVQLICVGPVIDLYGRFAALKLDRMMKVYPGRVFSRPEFTALPPYIFSGAEFALIPSRDEPFGLVAVEFGRKGALGIGARVGGLGQMPGWWYNVESVSTSHLLMQFKLAIEAALSSKTETRAMMRARSAKQRFPVAQWVEDLEILQSTAIQVHEKEVSRGHAGGRPMTPMTPSGATTPSGMMTPTTGSRGLKPLSQGVGMGLSVPHSRESSYSNLNRLSEYVAQKTPGESQPRESSGLQRSLSLGVRSGPGHRGRARKQKPGADNIPEGNEDGSSSDTESIPDYYDDEYTLTPAQIEESRRAQATRSISFSPETLQPPRSPLPAPPMSPGTPPSVEQTLLPPPKPFAAADAGNRLSSASVLSLDSVVGGKKDFKLQKVDPFFTDSNGEYARNFEQQLENLNGSNSESQLCIEEFLVKSERRWFNKFRDARLGRLRSPTPSVFRDNHSHGRGSPDGSMYVDEAGHRNSGDAVHDNGSDDTDDEFLLGKDYVPPTGLKKWMQIKIGDWPVYTLFLALGQIIAANSYQITLLTGEVGQTAEKLYGIATTYAITSALWWLVFRYFKSIVCLSTPWFLYGIAFLFIGSAHFESDSFTRGWIQNVGSGFYAAASSSGSIFFALNFGDEGGAPVSKWIFRACVIQGIQQVYVIVLWYWGSTMAHQSSQGLLTADNTISNTWKMTAICYPIAMLLWAIGLLLIFGLPNYYRQKPGKVPSFYKSLFRRKIVLWNFVAVILQNFFLSAPYGRNWSFLWTSSHTKPWQIVILCVIFFGLLWCAFLYIVAVLSKQHSWFLPVFACGLGAPRFLQIWWGVSGIGHYLPWVAGGYTGGALVSRSIWLWLGVLDSIQGLGFGIILLQTLTRMHMCFTLIVSQVLGSIATIVARACAPNNVGPGPVSPDITKGAGELANAWFWVALFCQLLVCAGFLLFFRKEQLAKP

SEQ ID NO: 10 - DNA, 7537 bp, Aspergillus nidulans
atggggaggctccagctctcaagcgggctgaaggccatagccctgctcacattcgcagcgacagcaacatgctggccatacgacgagtccctcgttgactacaacgtcaacacgaataagtcggccactaaccccgccgactactggggagaatggtcggatcacaagtaccatccgtcgccagagaactggcggtttccgttttacacactcttcatggacagattcgtgaatggggatccaacaaatgataacatcaacgggaccacgtttgagcacgatctcaattcaaatcagatgcgtcatggcggtgatgttgctgggctggttgatacgctggattacttgcaagggatggggatcaaggtgcgttgccgctattattcgtcaatttctggtaaagatatagttgatgctaacgatgcgatagggactgtaccttgctggaactccgctcatgaaccagccctggggctcggatgggtattcggcgctcgacaccacccttctcgaccagcactttggcacgatccaggtctggcgcgacgccatcaccgaaatccacaaacgggggatgtacgttctgttcgacaatacaatcgctacgtgagtacctcgcctccctgcgttttgccatcggtttgtaaaaaacttgggcctgacactagattactgcagcctcggtgatctcattggttttgaaggtcatctcaacgacaccacgcccttctccgagaaagaacacaaggccctttggaagtccaacagacggtacgtcgatttcgatattggcaacacctacaacgccacctgtgattatccgcgcttctggtacgaggacgggatgccagtcaatgagtccctgaccgcgggcctggtcgggtgttatgatagtgactttgaccagtacggtgacatcgaagcgttcggtgtctggccagactggaagcgtcaactggcgaagtttgcgtccgtccaggatcggttgagagaatggtacccacctgtacgggaacggctgatccgacacacatgcatgatcattgcctcctttgatatcgacggtattcggtacgacaaggcgacccaggcgactgtcgatgcgttgggggacatgtccaaagcgtatcgggaatgcgcgcgggctgtcggcaaggagaactttttcattgcgggtgagatcacaggaggcaatacttttgggtctatctatctcggacgaggacggcagtcgaaccaggtcgattcggtggggaatatctacgacgccatgaaactgacaaacgagtcggatccgcagcttttcctgcgcgaggtcggccacgaggctatcgacgccggtgccttccattactcgacttaccgtgccctgacccgcttcctgggaatggacgggcagctggaggccggttatgacgtccctcttgactgggtgcaggcatggggaaacatgaccgtgaccaacgacctgattaacgccaacacgggcaagttcgatccccggcacatgtacggcgtgacaaaccaggatgttttccgttggccggcaatcgagtggggtgttgagaggcagatgctgggctcgtttatcaccacgctgatgctgccgggcatcccgctgctgctttggggagaggagcaagcgttctacgtgctcgatgcgacggcgtcaaactacatatatggacgacaggccatgtcgtctgcgaccgcgtggaagacgcacggctgcttctcactcgaatcgagccagtactaccagtggcccctggtggccgcactcgacggttgcaacgacgagacggtcacctacgaccaccgggacccgagccacccggtgcgcaacatcatcaagcacatgtaccagatgcgcgagcagtacccaatgctcaacgatgggttcatcatcgagaccctttctaaccagacggaacctgtctactaccccggttccaacgggaccgagaccgagacaggcatgtggtcggtccgccgtgaccggaacgaagagacccaggactttggctcgagtgacgacaacgaacccatctggctagtctatagcaacatgaaccgcacgcacgactacacatttgattgctctgacaatgagacggcactcattgccgccttcccctcaggcaccaaggtcaggaacctctttcacccgtacgacacgctgaccctaggcgacgggccaaaggaaatggtctatggcaactcgactgagctggtaggctgcttaccgaacctgacgcttagccggtacgagttccgtgcctatgtcaagaacgagctctggaaaaagccccggccgatgatcaccaagttccagcccggcgacgatgaggccaacggccacgacagcccgctgcgttcgaccgtcgcaccagatgcgtccgagacggtgcgactgacgctgcagttttctgaggcgatgggatgcgattctgtcacagactccatctcatttaactcttccacggaaaccggcaagattccatccatcgacgcctccaccgtccagtgtgggaacatcactgaagtcgccaacagcaacgctaccgggcacatccccggtaagtggcagtgggctgcagatctgagaggggtgtacaacggcatccaccgggtcactgtcaacaacgccagcaacgccgacggggacgactccacccacgcagtcgaccacttcctcttccggattgggcagattgacaaccccatggtctttacctctgccaactactccagcagtttgctgcatgagaaggaggacggcacgttctatatccaacaccacgctgccggtgctgacaagtaccgctattcgacgaattggggcaccacgttctctgactggaaaacgtacaagggaggtaacgacacgattaccatgcttccatggaatggcactaaggcgcaggaatgggagggacatcacatccgcgtcgagtactggtcccgctggactggcagcagtagccacgtccaggaaggcgattccggctggaagtacaagacgccacgtcgcttcccacatgcctttttcaatgggccctacaaccagtacgggtacgacggcggtctggacaaccagatcaagctggacgcgggcgccggcggcgacggatactggaagtaccatttcacctcggagtggcctgccgtcgggcaggtgaatgtctggggcatcaatccggatggcgagcccgatcagagctgggtgatgggcgacgtggacggggacaaggtcctcgaccgcatgccaccaagcgcgctctctgcaacgctgattaacatcactgatcacccaacgcacccttatatctcgtggaagctgtacataaacgacgcgacgatgcggtactatctcatccccgctggccaccagagcgggcagatcgccatgttcgtcctcttctggatcatccctctcctgtccggctccgcctgcgtctatatcttcatgaagtccttctacaaggtcaaattcaacgaaatcggcgctgccggcgcaagcacggaaatgaagtcacttgtcccgcttgctctccgtcgacgcatgaagcagctcgcctctgggaatggcaagaacggtccgtcattcaacccgctcatgcgccttgctgaaaagtccggctttatgcagagcacgactgcgttggccggtgcggcctcgggcaagagacgcatggtcctgatcgcgaccatggaatacgatattgaagactgggggatcaagatcaagatcggtggtctgggagtgatggcccagctgatgggtaagacactcggccaccaggaccttatctgggtggtgccttgtgtcgggggcgtggactatcctgttgatacccctgcggaacccatgacggtcactatcctgggtcaggcataccaggtgaacgtgcagtaccacgttctgaagaacatcacgtacgtcttgcttgacgcgcccgtcttccgccagcagaccaagtcggagccgtacccagcgcgcatggatgacttggactctgcagtgtattactccgcatggaatcagtgtatcgcagaggcgatcaaacggttccctgttgatttgtaccatattaacgattaccacggctctgtcgcgccgctgtacctcctgccaggtaccatccccgcctgtctgtcacttcacaatgccgagtttcagggtctatggccgatgcgaacacagaaggagaaagaggaggtctgttccgtgttcaacctggatgttgaggttgtccgcaactacgtccagtttggtgaggtgttcaacctcctccacgcaggagcgagctatctccgcgttcaccaacagggctttggtgccgtcggtgtctcgaagaagtacggcaagcgttcatatgctcggtacccgatcttctggggcctgcgcaagatcggaaacctgccgaaccccgatccgtctgatgtgggcgagtggacgaaggaggacagcctgatcaaggacgaggatatcaaggtggatccagagtttgaagcaggccgcgctgagctcaagagacaggcgcaggagtgggctgggctggaccagaaccctgatgctgacctcctggttttcgtcggtcgttggtccatgcagaagggtgttgaccttatcgcagacgttatgcccgcagtccttgaagcacgaccaaacgtacagctcatctgtgttggacctgttatcgatctctatggccgctttgcggcgctcaagctcgaccgcatgatgaaggtgtatcccggccgcgtcttctcacgccctgaattcactgccctgccgccgtatatcttctccggcgcggaattcgcgcttattccctcccgtgacgaaccctttggtcttgtcgccgtcgagtttggccgcaaaggtgcgctcggcattggagcccgtgttggtggactgggacagatgcctggatggtggtacaatgtcgaatcggtctcgacatcccatctcctcatgcagttcaagctcgctattgaggctgccctttcgtcaaagactgagacacgtgctatgatgcgtgctcgctctgctaaacaacgcttccccgttgcgcagtgggtggaagatctggagatcctacagtcgactgctatccaggttcatgagaaggaggtttcccgtggtcatgcaggtggccgccccatgacaccgatgacgccctctggagctacgacgcccagcggaatgatgacgcctactacaggatcccgtggtcttaagcctctgtcccagggcgtcggcatgggcctctcggtgccacactcccgggagagcagctattcgaacctcaaccgattgagcgagtacgttgcgcaaaagactccgggcgagtctcaaccgcgagaatcgtccggtctgcagcgctcgctctcgctcggtgtccggtccggtcctggccaccgtggtcgtgcgcgcaagcagaaacccggcgcggacaacatcccggagggcaacgaggacggcagcagcagtgatactgagtctatccctgactactacgacgacgagtacaccctcaccccagctcagattgaagaaagcagacgggctcaggccacccgttccatatccttcagccccgagacactccagccacctcgatctcccctgcccgcacctcccatgagtcccgggacgccaccgtcggttgagcagactctgctgcctccaccaaagcccttcgctgccgctgacgctggaaacagacttagtagtgcatcagtgttatccctagactctgtcgtgggtgggaagaaagacttcaagctccaaaaggtcgaccccttctttactgacagcaacggcgagtatgctcggaacttcgaacagcagctcgagaacctcaacggctccaactccgagtcacagctgtgtatcgaggagttccttgtcaaatcggaacgccgctggttcaacaagttccgcgatgcaaggctgggtcgtctgcgctcgcccacaccgtctgtcttccgcgacaaccacagccacggccggggctcgcccgatggatctatgtatgtggatgaggcaggccaccgtaatagtggcgatgccgtgcacgacaacggctcagatgacacagacgatgagttcctcctaggcaaagactacgtgcctcccacgggcctgaagaaatggatgcagatcaagatcggcgactggccggtgtacacgctcttcctcgcactgggccagatcatcgctgcaaactcctaccagatcacgctgctgacaggcgaagtcggccaaacagccgagaaactgtacggaattgccacaacctatgccataacctcagccctctggtggctcgtcttccggtacttcaaatccatcgtctgcctctccaccccctggttcttgtatggaattgcgttcctcttcattggctccgcgcactttgagtccgactcattcacccgcggctggatccagaatgtcggcagcggcttctatgctgcggcttcctccagcggatccatcttctttgcgctgaacttcggtgatgagggcggtgcaccagtgagcaagtggattttccgtgcatgtgtgattcagggcatccagcaggtctatgtcattgtgctctggtattggggttccacgatggcacaccagtccagccagggtctgctcacggcggataatacgatctcaaatacgtggaagatgacgtacgtccaaaacgaccctaaattacccccaattaatatacagaactcactaacaaactgatacagcgccatttgctatccgatcgccatgttactgtgggccatcggcctcctgctgatcttcggcctaccaaactactaccgccagaaacccggcaaagtaccctccttctacaaatcccttttcagacgcaagatcgtgctctggaactttgtcgccgtcatcctacagaacttcttcctgtcggctccctatggccgcaactggagtttcctctggacatcctcccacacaaagccctggcagattgtcatcctgtgtgtcatattctttggtcttctgtggtgcgcgttcctttacattgtcgctgttctttcgaagcagcactcctggtttttgccagtcttcgcatgcgggctcggcgccccccgcttcctgcaaatctggtggggtgtttctggcatcggacactaccttccctgggttgccggcgggtatactggcggcgcactagttagtcggagtatctggctgtggctaggtgtgctagattcaatccaggggttagggttcggaatcattctcctccaaaccctgacccggatgcatatgtgctttacgttgatcgtcagccaagtcctgggatctatagcaaccatcgttgcgagggcatgtgctccaaataatgttggtccgggacctgtgagtccagatatcacgaagggagcgggcgaactggcgaacgcctggttctgggttgcattgttctgtcagttgcttgtctgtgctgggttcttactgtttttccgcaaggagcaacttgcgaagccttaa

SEQ ID NO: 11 - protein, 2396 aa, Aspergillus sojae
MKWGFTGSLLALLAATAAGWPYDESLVDYNLNVNKDTTNPAEYTHAEWKGHTYHPSPESWRFPFYTLFIDRFVNGDPTNDNINGSLFEHDLNSNQMRHGGDAAGLVDTLDYLQGMGIKGIYLAGTILMNQPWGSDGYSILDTTLLDQHYGTIQTWRDAITEIHKRGMYVLFDNTIATMGDLIGFEGYLNTTTPFSVKEHKALWKSDRQYIDFRFDNEYNNTCEYPRFWNETGYPVDKDVTDELVGCYNSDFDQYGDREAFGVYPDWERQLAKFASVQDRLREWHPSVKERLIRHSCMIIKALDIDGFRYDKATQATVDALGDMSHAYRECARSVGKDNFFIPGEITGGNNFGSIYLGRGRQPNQYPDSSLASMNLTNTSDHQYFLRDHGLQALDSAAFHYSVYRTLTRFLGMDGNLAAGYDTPLDWTDSWNIMVLSNDMINANTGKFDPRHMYGTTNQDVFRWPAIELGVERQLLGHFITTLHLPGIPILLWGEEQAFYILDSTADNYIYGRQAMSPSTAWKTHGCYSLGSSQYYNWPISAGREGCHDEAVAYDHRDPSHPLHNIIKHMFQMRQDFPVLNDGYSVVKLSKQTHEIQYPGSNGTATEVGVWSVMRDIVSNIQDFGDSGNNEPVWLVYQNDNKTVEYSFDCGSNDSALISPFTTGTTVVNLFYPHDEHELKDGPKSLHLNGTNATNGCLDSLKMKPFEFRAYVPKANFVKPRPMITQFEPGHDVPQLSKVGPDESEDIDVSIYFSTKMDCDQVTKSISFESSTEAGKTPSISNNSVSCKDAKGDDPKWTGQIPNAWVWTAKLTGVYNGIHRLTVKNATSSDGHSSTQATDHFLIRVGQRDNPLVFTSANYSTSLLNQYDNGTLYIQHRAAGANKYRYSTNFGSSFSDWKDYHGGNDTIEELPWSGTDKQKWQGKHVRVEYWNKLTGSSDYAQEGDSGYDHPRRFPHLFFNGPFNQYGYDAGLDNVVRQDSDGLWKFRFMAEFPAQGQFNVWGMNPDGQPDQSYVFGDIDDDGVLDRMPPSSLSSTIINITDIPPSPYLAWNLGVDDGTLRVHLLPTGSRTIQMVVYFLLWFVPLVTAIACVYAFVKSFYQVKFNQVGVSEKKSILPLAFRRKMNPDGSGGSINPFMRLANKSGFLQSTPAFGAVASRRRTTLIATMEYDIEDWAIKIKIGGLGVMAQLMGKHLGQQDLIWVVPCVGGVDYPVDQPAEPMFVTVLGNSYEVQVQYHVLNNIKYVLLDAPVFRQQTKSEPYPARMDDLDSAIYYSAWNQCIAQAIRRFPIDLYHINDYHGSIAPLYLLPQTIPVCLSLHNAEFQGLWPMRTQKERDEVCSVFNLDLDTAKRYVQFGEVFNMLHAGASYLRVHQQGFGAVGVSRKYGKRTYARYPIFWGLKKVGNLPNPDPSDTGEWNKELPKDSEIQVDANYEASRGELKRQAQEWAGLDQNPDADLLVFVGRWSMQKGVDLIADVMPAVLEARPNVQLICVGPVIDLYGKFAALKLDHMMRLYPGRVFSKPEFTALPAYIFSGAEFALIPSRDEPFGLVAVEFGRKGALGIGARVGGLGQMPGWWYNIESTTTSHLLHQFKLAIGSALNSKPQVRAKMRARSAKQRFPVAQWVEDLEILQTTAMRIHSKGQAKSNGGPLSPSGYNTPSEVITPSGMMTPTIASTGTTTPTGMQTPPIAHSREGSYTNLSVNRDSAYGPQQRNTIVYSRDPSPGGNDEPRLSLGRQLSLGFRAGPGHINLRGRRLKRRSQMGNEESGTATEESSDDDYFRGEEEVTITREQADEGRHQRNPLRSLASPTNSYFEEGITSGRPPWAQPGNRLSSASVLSVDSVVGEKKDYKLQKVDPFFTDGTGEYYRVFDQRLEKLNGSNSESQLCIEEYLMKSEKKWFDKFRDARLGRNQSPASSIFQTKGENNTPMSSISHEDLGSNESGSDPRAEKDEFLLGRDYVPPSGLRKWMQIRIFGWPVYSFFLGLGQIIAANSYQITLLAGENGQTAGKLYGIATVYLVTSIIWWFFFRFFKSVFVLSIPWFLYGASFVIIGLAHFESNGFARGWIQNVGSGVYAAASSSGSLFFALNFGDESGVQVKDWVFRACLIQGTQQAYVIGLWYWGTTISSAVANGVTNVNGGIVNSWKMTAICMPIAAFLWAIGLIIFFGLPNYYRQSPGKVPSFYKSVFRRKIVLWNFVVVILQNFFLSAPYGRNWAFLWSSNHAEAWQVGILVVVFFGVIWVAVLTLFGYLSKRHSWILPVFACGLGAPRWAQIWWGVSGMGLFLPWAGSSVSGALASRSLWLWLGILDALQGLGFGMILLQTLTRVHIAFTLLASQVLGSIATIVARACAPNNIGPGPISPDVTAGGSSVANAWFWIALFFQLLICAGFLLFFRKEQLTKP

SEQ ID NO: 12 - DNA, 7488 bp, Aspergillus sojae
atgaagtggggattcactggctcgttgcttgcgttgctcgcagcaacagcagcaggctggccctatgatgagtccctagtcgattataacttgaatgtgaataaggatactaccaatccggctgaatatactcacgcagaatggaagggccatacgtatcatccctctccagaaagctggcgtttccccttctataccctgttcattgaccggtttgtcaatggtgatcccactaacgataacatcaacgggtcactctttgaacatgatcttaattcaaatcaaatgcgtcacggtggtgatgcagctggcttggtcgatacactagactacctacaaggaatgggcataaaggttcgtggcaatgatttgcgtgttgtttcttgctattggtgtttacagcatatggctgactgacctctacaggggatctatttggctggtactatcttaatgaatcaaccatggggctcagacggttactcgattttggatactaccctgcttgatcagcattatggtacaattcaaacctggagagacgcaatcaccgagattcataagcggggcatgtatgtcctctttgacaatactatcgcaacgtaagatgctgcccctcgcctaagtcgttacattccagcgctgacatgaaaccagcatgggcgatttgattggatttgaaggttatttgaatactaccacgcctttctcagtcaaggagcacaaagcattgtggaaatctgaccgtcagtatatcgacttccgttttgacaatgagtacaacaacacttgcgaataccctcgattctggaacgagactggctatccagtcgataaggatgtcacagatgagctagtcggatgctataacagtgatttcgaccagtacggtgacagagaagctttcggtgtctacccagactgggagcgtcagttggccaaattcgcttcagttcaagatcgtctacgtgaatggcaccctagcgttaaagagagacttattcggcactcgtgtatgattataaaggccctggatattgatggcttccgctacgataaagcgacgcaggccacagtggatgctcttggtgacatgtcccatgcttatagagagtgtgctcgcagtgttggcaaggataacttcttcattcctggggaaatcactggtgggaataactttggttctatttacctcggacgtggaagacagcccaaccaatacccagactcctccttggcttcgatgaacctgacgaacacctctgatcatcagtatttcttacgtgatcacggtctacaagcgctagattcagcagctttccattattcggtgtaccgtaccctcacacgattcctaggtatggatggcaacctggctgcgggctatgacacaccgttggactggacggactcctggaatattatggtattgagcaacgatatgatcaatgctaacactggcaaattcgacccccggcatatgtatggtactacaaaccaggatgttttccgttggcctgccatcgagctcggagtcgagagacagctcttgggtcacttcatcacaaccttacatctccccggcatcccgattttgctgtggggagaagaacaagccttctacattctagactctactgcggataactatatctatggccgtcaagcaatgtctccctccactgcgtggaaaacacacggatgttattcccttggttcgtcccaatactacaactggcctatcagcgcaggtagggaaggatgtcacgatgaagctgtcgcttatgatcatcgagatccctctcatccactccacaatatcatcaaacacatgttccagatgcgacaggacttccctgtactgaatgatggatactcagttgtcaagttgtccaaacagactcatgagattcagtatcctggttcgaatggcacggcaacggaagtcggcgtctggtcagttatgcgtgatattgtctccaacattcaggactttggtgacagcggcaacaacgaacccgtctggctggtctatcaaaacgacaacaagaccgtggaatatagctttgattgtgggagtaacgattcggccttgatttctccatttactacgggaactactgttgttaatctcttctacccacacgatgaacacgagctgaaagatggccccaaatcacttcatctgaacggcaccaatgcaacaaatggttgtctggatagtttgaagatgaagcccttcgagttcagagcttacgttccaaaggctaactttgttaagcctcgtcccatgatcacccagttcgagcctggtcacgatgtgccgcagctgtctaaagtcgggcctgacgaatcagaagatattgacgttagcatttacttttccactaagatggattgtgatcaggttacgaaatccatttcattcgaatccagtactgaagctggcaagactccctctatcagtaataacagtgtcagctgcaaagatgccaagggtgatgatccgaagtggactggtcaaatccccaacgcctgggtctggacagcgaagttgactggcgtttacaacggtatccatcgcttgaccgtcaaaaatgcaactagttcggatgggcatagttctacccaagcaactgatcacttcttgatccgagtgggccaaagggataatccgttggtgttcacatctgcgaactactcgacctccttgttaaaccaatatgacaatggcacgctctacatccaacatcgtgcagcaggcgcaaacaaataccgctattcaacaaattttggttcctcattctctgactggaaagactaccacggaggaaacgatactattgaagaactgccctggagtggaacggacaagcaaaagtggcaagggaagcacgtgcgagtcgaatactggaataagttaaccggcagcagtgactacgctcaggaaggcgactctggatatgaccatccacgacgctttccccatcttttcttcaacgggccatttaaccaatatggatatgatgcgggcttagacaacgttgtgaggcaagacagtgatggtctttggaagttcagattcatggctgagtttccagcacaaggacagttcaatgtttggggaatgaatccagatggtcaaccagaccagagctacgtgttcggtgatatagatgatgacggagttttggaccgtatgcctccttcttcgcttagttccacgataataaacatcacggatatccctccatctccatacttggcgtggaatcttggtgttgacgacggaactctgcgtgttcatcttctgccaacgggttcaaggaccatccagatggttgtgtacttcctcctctggtttgttccccttgtcacagccatcgcttgtgtctatgccttcgtgaaatccttctaccaagtcaagttcaaccaagtgggggtcagcgaaaagaaatcaattcttccattggcattccgcaggaaaatgaaccccgatggaagcgggggatcaatcaatcctttcatgcgccttgccaataagtccggattcttgcaaagcacacctgcttttggagcagtagcttcacgaagacggacgaccttgattgccaccatggaatatgatattgaggactgggccatcaagattaaaatcggtggtctgggtgttatggctcagcttatgggcaaacaccttgggcagcaggatctaatttgggttgttccatgcgtgggaggagttgactacccggtagatcagccagctgagcctatgtttgtgacagtgctcggaaattcctacgaagtccaggtgcaatatcacgtcctgaataacattaaatatgtccttttagatgctcctgtttttcgtcaacagaccaaatctgagccttatcccgcccgaatggacgatttggacagcgcaatctactattccgcttggaaccagtgcattgcacaagcaatcagacgtttcccaattgatctttatcatatcaacgactaccatggatccattgcccctctttatcttctgcctcaaaccatccctgtttgtctgtcgctccacaatgccgagttccaaggactgtggcccatgcgtacccagaaggagagggatgaagtctgttctgttttcaaccttgatcttgacactgcaaagcgttacgtccagtttggcgaagtttttaacatgcttcatgctggagcaagctacctacgcgtgcatcaacaagggtttggtgcagtgggcgtttctcggaagtatggtaaacgtacttatgcccggtaccctatcttttggggtctgaagaaagttggaaatctaccgaacccggacccttcagacactggcgaatggaacaaggagttaccaaaggacagcgagattcaggttgacgcgaactacgaggccagcagaggggagcttaagcggcaagcgcaggaatgggcgggcttggatcagaaccctgatgctgacctgttggtgtttgttggaagatggtctatgcagaagggcgtggaccttattgctgatgtgatgcctgccgttctggaagcacgtcccaatgttcaactcatctgtgttggtccagtcattgatctttatggtaaatttgctgcgcttaagctcgaccatatgatgaggttgtatcctgggcgtgtcttctcaaagcctgagtttactgcacttccagcatatatcttctctggcgctgaattcgccctgattccatctcgtgatgaaccttttggtcttgttgctgttgaatttggtcgaaagggcgctcttggtattggcgctcgtgtcggtggtctcggccagatgcctggttggtggtataatattgagtctacaacaacttcccatctcttgcatcaattcaagcttgcgattggaagcgcgcttaactcgaagccccaagttcgtgcaaagatgcgtgcacgctctgcaaagcaacgctttcctgttgctcagtgggtggaagatttagaaattctgcagaccactgctatgcggattcacagcaagggacaggcaaaatcgaacggtgggcctctctcgccttctggttacaatacaccaagtgaagtaataacaccaagtggaatgatgacacctacgattgcatcgactggtaccacgaccccaacagggatgcagacacctccaatcgcacactcacgggaaggcagttacacgaatctcagcgtcaaccgcgacagtgcatacgggccccaacagcgcaacacaattgtgtacagccgtgacccaagtcctggaggtaacgacgaacctaggttaagccttggtcggcaactgtcacttggattccgggctggaccaggacatattaatctccgtggtcgtcggcttaaaagaagaagccagatgggcaacgaggagagtggtacagcgaccgaagaaagcagtgatgacgattatttccgcggagaggaagaagttacgattacgagggagcaagcagatgaaggacggcatcaacgcaatcctctgaggtcgcttgcatctcctaccaactcttactttgaagaaggcataacatccggaaggccaccttgggctcaacctgggaatcgactcagtagtgcatccgttctttctgttgattctgtcgtcggcgaaaagaaagactataagctgcagaaagttgatccattcttcacagacggtactggcgaatactatcgagtgtttgatcagagactcgagaagctcaacggatctaactctgaatctcagctttgtatagaggagtatctgatgaagagcgaaaagaagtggtttgacaagtttagagacgcaagattggggcgcaaccaatctcccgcttcttcgattttccaaaccaagggcgaaaacaacacacctatgagctcaatctcccacgaggatctgggttcaaacgaaagtggcagcgatccacgcgcagaaaaggacgagttccttctgggacgagactatgttcccccctcgggcttaaggaaatggatgcaaattcgaatctttggctggcctgtgtattcgtttttcctaggtctcggtcagatcattgcggccaactcgtaccagattaccttgcttgccggtgaaaacggccagacagctgggaagctctatggtattgcgacagtataccttgtcacttcaatcatctggtggtttttcttccgcttcttcaaatcggtgtttgtcctttccataccttggttcttatacggcgcatcgtttgtcatcattggattagcacactttgagtcaaatggcttcgctcgtggatggatccagaatgtgggaagcggtgtttatgctgctgcttcttcaagtggatcactgttcttcgctctcaattttggcgatgaaagcggtgttcaggttaaagactgggttttccgcgcatgcctcatccaaggaactcagcaagcatatgttattgggctgtggtactggggaacgacaatctctagcgctgtcgccaatggagttaccaacgtcaacggtggcattgtcaactcctggaaaatgacgtacgtttcaccgttatcattatgattacaattgctaacaggctcttgtagcgcaatctgcatgccaatcgctgcattcctctgggccattggtctgataatcttcttcggcctgcccaattactaccgccagtcacctggaaaagttccatcattctataagtctgtcttccggcgcaagatcgttttgtggaacttcgtggtagtcattttgcaaaacttcttcctcagcgcaccttatggacggaactgggcctgtaagtacatcagacctatactctccaagaagccactaacttatcgtgccccatacagtcctttggagctcaaaccatgccgaagcctggcaagtcggcatcctcgtcgtcgtcttcttcggtgtcatctgggtagcagtgttaaccctgtttggatatctctccaagcgccatagctggattctacctgtattcgcatgtggtttgggagctccacgttgggcccagatatggtggggtgtctccggaatgggtctcttccttccctgggctggcagttctgttagcggagcactcgcatcacgaagtctatggctctggctcggtatccttgatgccttacagggtctcggcttcggcatgattcttctccagaccctcacacgagtacatatagccttcaccctgcttgcatctcaagtgctgggttccatcgcgacaatcgtcgccagagcatgtgctccaaacaacatcggccctggaccaatctccccagatgtgactgccggtggcagttccgtcgcaaacgcttggttctggatcgccttattcttccagctcttgatctggtaagtcatcgatccccctacaatccatttcacaggaagcaaaatactaacaaagccccagcgctggattccttctgttcttccggaaagaacaactcaccaagccctaa

SEQ ID NO: 13 - protein, 2422 aa, Aspergillus sojae
MKWAFSSTVLALFATTATAWPYEESLSAYNLNENKSATNPAQYWGEWPDHKGKYFPSPDNWRFPVYTLFMDRFVNGDPTNDNINGTLFEHDISSTQMRHGGDVAGLVDTLDYLQGMGIKAIYLAGTILMNQPWGSDGYSALDTTLLDQHFGDIATWRNAIDEIHKRGMYVIFDNTIATMGDLIGFEGHLNDTTPFSVKEHKALWKSDRRYVDFDLGNDYNQTCDYPRFWYEDGYPVQQSMTEGLVGCYDSDFDQYGDIEAFGVFPDWQRQLAKFASVQDRLREWHPSVRERLIRHSCMIIYQLDIDGFRYDKATQSTVDALGDMSMAYRECARAVGKENFFISGEITGGNTFGSIYLGRGRQPNQYPKTAEEAMKMTNESESQYFLREAGHEAIDGAAFHYSTYRALTRFLGMDGNLAAGYDVPVDWVDAWNLMLQSNDFINPNTGKFDPRHMFGATNQDVFRWPTVEKGVERQLLGLYITTLLLPGIPLLLWGEEQAFYILDATASNYIYGRQAMSPATAWRDHGCFSLDSSQYYQWPIQAGREGCHDPTAAYDHRDPAHPVRNIIKHMYQLREDFPVLNDGYSVQKLSNLTEEVFYPGSNGTATETGLWSVLRDVNAEVQDLGSDAKNQPVWLVYHNTNRTIDFKFDCKDNETALISPFPTGTKVRNLFYPYDEHTLIDGPVKLGLNGSTELNGCLANMTLDAYEFRAYVPSTRFTKPRPMITQFTPGHDVPVRSTVAPDMDESVKIELYFSEEMDCDSVTKAISITSSTESRKVPTLDEKTVDCKGIPASNTSWTGQLPSVFMWAANLTGVYNGIHRVTVKNASSTNGNATTNAVDHFLFRIGQIDNPMVFTSANYSTSLLHEESNGTLFVQHHAAGADKWRYSTNWGTTFSEWKDYTGGNDTITELEWSGTKKQRWQGHHVRVEYWSKWTGSSDYVQEGDVGVHSNLPRRFPHIFFNGPYNQYGYDGGLDNVVRQDSKDGLWKYHFTAEWPAQAQLNIWGMNPDGKPDQSWVLGDADNDSVLDRMPPSSLSATLINITEHPPKPYLAWNIYINDATMKFQLFPVGHQNTQIAMFVLFWIIPVITGAACVYIFMKSFYKVKFNQIGVSEKATLIPLALRRKFKRNRGGDEEKMNPLMRLANKSGFLQTNTAIGGAASGKRRMVLIATMEYDIEDWQIKIKIGGLGVMAQLMGKTLGHQDLIWVVPCVGGVEYPVDTPAEPMNVTILGNSYEVQVQYHVLNNITYVLLDAPVFRQQSKSEPYPARMDDLNSAIYYSAWNQCIAEACKRFPIDLYHINDYHGSLAPLYLLPDTVPACLSLHNAEFQGLWPMRTQKEKEEVCSVFNLDIDIVRRYVQFGEVFNLLHSGASYLRVHQQGFGAVGVSKKYGKRSYARYPIFWGLRKVGNLPNPDPSDVGEWSKEKAIGNADEVHVDPDYEAGRADLKRQAQEWAGLEVNPDADLMVFVGRWSMQKGVDLIADVMPAVLEARPNVQVICVGPVIDLYGKFAALKLDHMMKVYPGRVFSRPEFTALPPYIFSGAEFALIPSRDEPFGLVAVEFGRKGALGIGARVGGLGQMPGWWYNVESTATSHLLYQFKLAIDAALNSKQETRAMMRARSAKQRFPVAQWVEDLEILQTTAIQVHNKELVKHNGRPFTPTGTITPSGLMTQPASPPMTPGMQTPLAHSRESSYSNLNRLSEYVTQPKTSYSRDPSPSGTEKPKSGLQRQLSLGVRSGPGHQSRRGRARQRDSIPEHEDTQEAHGGAITDVEEESSDDDIVNHYADDEYTLTPAQVEEGRRLQAAQQQAGGRRYSQDSLHPRNVQPPSSPGTPPAASQSLLPPPRLLDPGSRLSSASVLSLDSVVGGKKDFKLQKVDPFFTDSTGEYYKVFDKKLDELNGSNSESQLCIEEYLIKSEKEWFDKFRDARLGRTKSPTPSVYRDKHGASPIGSFYDDNGSRISGSDGPHSNDSEDDEFLLGKDYVPPTGLKKWMQIRIGDWPIYSLFLALGQIIAANSYQITLLTGEVGQTAEKLYGIATTYLITSILWWLVFRYFKSVVCLSAPWFLYGIAFIFIGSAHFESNSFSRGWIQNVGSGFYAAASSSGSFFFALNFGDEGGAPVETWIFRACLIQGIQSAYVIALWYWGSTLSQAQSEGLLTPTNNISNSWKMSAICYPIAAALFGIGLLLTFGLPNYYRQTPGKVASFYKSVLRRKIVLWNFVAVILQNFFLSAPYGRNWQFLWTSHHVHHWQIVILCVVFYGFVWAGFLFVVSRYFKSHSWFLPVFACGLGAPRWAQIWWGVSGIGYYLPWVTGGYTGGALVSRSVWLWLGVLDSIQGLGFGIILLQTLTRMHMVFCLVCSQVLGSIATICARAFAPNNVGPGPVSPDPTFGGSAVANAWFWVALFCQLLVCAGYILFFRKEQLSKP

SEQ ID NO: 14 - DNA, 7590 bp, Aspergillus sojae
atgaagtgggctttctccagtacggtgctggcgcttttcgcaacaacagcaacggcctggccttacgaagaatcactatccgcatacaaccttaacgaaaacaaatccgcgaccaacccggctcaatattggggagaatggccggaccacaaggggaaatacttcccttctcccgacaattggcgatttcccgtctataccctgttcatggaccgctttgtcaacggagaccctacgaatgacaacattaatgggaccctcttcgagcacgatatctcctcgacacagatgcgccatggtggagatgtggctggtctagtggatactttggattatcttcagggaatgggtatcaaggtgcgtcattcgttcatttcaattacgtgggatggcatactgagaattcgtaggccatctatctcgcaggaactatcttgatgaaccagccatggggctctgatggttattccgctctcgatacgacgctgctcgaccaacacttcggtgacattgcgacatggcgtaatgctatcgacgagattcataagcgcgggatgtatgtcatctttgataacacgattgctacgtaagtcttgccgcatccacgatagtacatatgaggtgattgttaacgcttgtattcaggatgggtgatctcatcggcttcgagggccacttgaatgataccaccccgttttcggttaaggagcataaagcgctttggaagagcgatcgtcgctatgtggatttcgatctcggaaacgactataaccagacatgcgactacccccggttctggtacgaggacggttatccagttcaacagtccatgaccgagggccttgttggttgttatgacagtgactttgatcaatatggtgatattgaggccttcggcgtgttccctgattggcaacgtcagctagcaaaatttgcgtccgtccaagatcgtctacgagaatggcacccctcggtgcgggaacggctgattcgccattcctgtatgattatctaccagttggatatcgacggtttccgttatgataaggcgactcagtcgaccgtggatgcgctgggagatatgtcgatggcttatcgcgaatgcgcccgtgccgttggcaaggagaatttcttcatctccggtgaaattactggtggtaacacttttggttctatctatttgggccgaggcagacaacctaaccagtatcctaagacggcggaggaggccatgaaaatgaccaacgagtccgagtcgcaatacttcctgcgtgaagctggacatgaggcgatcgacggcgcggccttccactattcgacatatcgtgctctgactcggttcttgggtatggatggtaacttggccgccggttacgatgttcctgtggattgggtcgatgcgtggaatttgatgttgcagtcgaacgacttcatcaaccctaacacgggcaagttcgatccccgccatatgtttggcgcgaccaaccaggatgttttccgctggccaacagtcgaaaagggtgtggaaaggcagttgcttgggctgtatatcactaccttacttcttccgggcattcccctcctcctttggggcgaggaacaggcattctatatcttagatgcgacagcatctaactatatctatggccgtcaagcaatgtcccccgcgactgcgtggagagaccacggttgcttttccttggattcctcacagtattatcagtggccgattcaggccggtcgtgagggttgccatgatccaactgctgcgtacgatcatcgtgatccggcccacccggtgcgcaacattattaagcacatgtaccagctgcgcgaagacttccctgttctgaacgatggctactccgttcagaaactctcgaacttgaccgaggaggtcttctatccgggctccaacggtaccgctacagaaacgggtttgtggtctgtcctacgtgatgtcaatgcggaggtgcaggacctgggctccgacgcgaagaatcaaccggtttggctcgtctaccacaacaccaaccgtacaattgacttcaagttcgactgcaaggacaacgagactgcactaatctcccccttccccaccggcaccaaagttcgaaatctgttctatccctatgacgagcacaccttgattgatggccccgtcaagcttggactgaacggatctaccgagctcaacggctgcctggccaacatgacattggacgcctatgagttccgcgcctacgtccccagtacacgtttcactaagccccggccgatgatcacccagtttactcccggccatgacgtccctgttcgctccacggtggctcccgatatggatgaaagcgtgaagattgagctctatttctccgaagagatggactgtgattccgtgactaaagcaatctccattacctcttctacggaatctagaaaagtcccgacactggatgagaagactgtagattgcaagggaattccggcaagcaacacatcgtggactgggcagctccctagcgtcttcatgtgggctgccaacctgacgggagtgtacaacggcattcaccgggttacagttaagaacgctagcagtactaatggaaacgcgacgacaaacgccgtcgaccacttcctcttccgcattggacaaatcgataatcccatggtctttacatcggccaactattcgactagtttgctccacgaggaatcgaatggtaccctgttcgtccagcatcacgcggctggtgctgataagtggcgttattctaccaattggggcaccactttctccgagtggaaggattacacaggtggcaatgacactatcacggagttagaatggtctggaaccaagaaacagagatggcagggacaccatgtgcgggtcgagtattggagcaaatggaccggtagcagcgattacgttcaggagggcgatgttggagtgcattcgaatctgcctcgccgcttcccccatatcttcttcaacggcccttacaatcagtacggctatgacggtggtcttgataacgtggtgaggcaggactccaaagacggtctctggaaatatcacttcacggcggaatggcctgctcaagctcagctgaacatttggggcatgaatccggatggaaagcctgatcaaagctgggtgctgggtgatgccgataatgattccgttctggatcgaatgccaccctcctctctgtctgcaaccttgatcaacatcaccgagcatccgcctaagccttatctggcttggaatatctacatcaacgatgcgaccatgaagttccagctcttccctgtggggcaccagaacacgcagatcgccatgttcgtgctcttctggatcatccctgtcatcaccggtgcagcatgcgtctacattttcatgaagtctttctataaggtcaagttcaaccagatcggtgtgagtgaaaaggccacattgatccccttggctttgcggagaaagttcaagagaaatcgtggtggtgatgaggaaaagatgaatcccttaatgcgtctggccaacaagtccggtttcctgcagaccaacaccgctattggcggcgctgcttctggcaagagacgcatggttctcatcgcgaccatggagtatgatatcgaggattggcagattaagatcaagattggtggtcttggtgtcatggcccagcttatgggtaaaactctcggacatcaggacctgatctgggttgttccctgtgtcggcggagtcgaatacccagtggatacacccgctgagcccatgaatgtcacgattcttggcaactcctatgaagttcaggtccagtaccatgtcttgaacaatataacctacgttttgctagacgcccctgtgttccgtcagcaatcgaagtccgaaccctatccagcccgtatggatgacctcaacagtgctatctactactccgcctggaatcagtgtattgctgaggcctgcaagcggttcccgattgacctgtaccatatcaacgattatcacggttctctagctccgctctaccttcttcccgatactgtaccggcttgtctctcccttcacaatgctgaattccagggtctctggccaatgcgtacacagaaagaaaaggaagaggtgtgctccgtctttaacctggatattgatattgtcagacgttatgtgcagttcggtgaggttttcaacttgctgcactcgggtgctagttatcttcgtgttcaccagcagggtttcggtgccgtcggtgtgtccaagaagtacggaaagcgttcctacgcccgttatcccatcttctgggggttgagaaaggttggcaacctgcctaaccctgatccttcagatgtgggagaatggagtaaggaaaaggctattggcaacgctgacgaggttcatgtggatcccgactatgaagccggcagagccgacctcaaacgccaggctcaggaatgggctggtcttgaagtcaaccccgacgctgatcttatggtgttcgttggtcgttggtccatgcagaaaggtgttgatttaatcgccgatgtgatgcccgctgttcttgaagctcgtcctaacgtccaagtgatttgtgttggacctgttatcgatctttatggtaaattcgccgccttgaagttagaccacatgatgaaggtttaccctggacgtgtgttttcgagacctgaattcaccgctcttccgccttatatcttctctggtgctgaattcgcgcttattccttctcgtgacgagccctttggtctagtcgcagtcgagttcggccgtaaaggagccttgggtattggtgcccgtgttggtggtctcggtcagatgcctggttggtggtataacgtcgaatctactgcgacatctcatcttctgtaccagttcaaacttgccattgacgccgcactgaactcgaaacaagagaccagagccatgatgcgtgcccgttctgctaaacagcgattccccgtcgcccaatgggtcgaggacctggagatcctgcaaaccaccgcaattcaagtacacaacaaggaactggttaagcacaacggtcggccgttcactcctactggaacaattactcctagtggccttatgactcagcctgcgagcccgcccatgactccgggtatgcaaactcctcttgctcattccagggaaagcagctactcgaacctcaaccgcttaagtgaatacgttacccagccgaagaccagctacagcagagatcccagccctagcggcacggagaagccgaaatcaggacttcagcgacagctttcacttggtgttcgctctggtcctggtcatcagagccgtcgtggtcgcgctcgccagcgtgacagtatcccagaacacgaagacactcaggaagcccacggtggcgccattactgatgttgaggaagaaagcagtgacgacgatattgtcaaccattatgcggacgacgagtatactcttacgccggcacaagtcgaagagggccgcaggttacaggccgcccagcaacaggctggtgtgcgcatgccgttgagtccaggtggtagacgctacagccaagactcattgcatcccagaaatgtccagcctccttcaagtcccggaacacccccagccgcttcccagagcctccttcctccccctaggctcctcgatcccggcagccgtctcagtagcgcatccgttctctcacttgactccgttgtcggtggcaagaaggacttcaagctgcagaaggttgatccgttcttcaccgatagcaccggcgagtattacaaggtctttgataagaaacttgatgaactcaatggatcgaactcggagtcgcaactgtgtatcgaagaatacttgatcaagagtgaaaaggaatggttcgataagttccgtgacgccagacttggtcgcaccaaatcgccaactccctcagtctaccgtgataaacacggcgcctcacctatcggctcgttttacgatgataacggctcccgcattagtggtagcgatggccctcactccaatgacagtgaagacgacgagttccttctcggaaaggactatgtccctcccactggtctcaagaagtggatgcagatccgcatcggtgactggcctatctactccttgttcctcgctctaggccaaatcattgctgccaactcgtaccagatcacattgctcacgggtgaagtcggtcaaactgccgagaaactgtacggcattgcaaccacgtatctgatcacgtctattctgtggtggcttgtgttccgctacttcaaatccgtcgtctgtctgtctgcgccatggttcttgtacggtattgccttcattttcattggatccgcccattttgagagcaactctttcagtcggggatggattcaaaatgtcggtagtgggttctacgctgcggcctcgtctagtggttctttcttcttcgcattgaacttcggtgatgaaggtggtgcacctgtggaaacatggattttccgtgcatgcttgattcagggtattcagtccgcctatgttattgctctctggtactggggttcaaccctgtcacaggcacaaagtgagggtctcttgactcctacaaacaatatttccaattcctggaagatgaggtttgttctattaacattcaatcgttaattctactagctaactgagcctttcacagtgcaatctgttaccccattgccgccgccctttttggaatcggcttgctcttgacattcggtctgcccaattattatcgccagactcctggaaaggtcgcttccttctacaagtccgtgttgcgtcgtaagatcgtcctctggaactttgtcgcggtcatccttcagaacttcttcctcagcgccccctacggccgcaactggcagtgtaagttgacctctgtataacggcttctctcacaccagaccaaactaactgtgtctctttacagtcctctggacatcccaccacgtacatcactggcaaatcgtcatcctctgtgttgttttctacggcttcgtatgggcaggtttcctattcgttgtcagtcgctacttcaaatcacacagttggttcctccccgtgttcgcctgtggcctcggagcgccccgctgggcacaaatctggtggggtgtgtctggcattggctactaccttccttgggtgacaggaggatataccggcggcgcgctcgtctcccggagtgtctggctctggctcggcgtgctggactcgatccagggtctcggcttcggtatcatcctcttgcaaaccctcactcgcatgcacatggttttctgtcttgtttgttctcaagtccttggttcgatcgctactatctgcgcgagagccttcgcccctaataatgtgggcccagggccggtttcgcctgatcctaccttcggtggtagcgctgttgcgaatgcctggttctgggttgctctgttttgtcagttgttggtctggtaagttattcacattccttaaacttcgttattataggataattgctaacgtgtcgtgttttcagtgccggttacatcctcttcttccggaaagaacagctgtcaaagccgtaa

SEQ ID NO: 15 - protein, 2387 aa, Aspergillus sojae
MFLTVMQRSAILILSLLSATALSWPYTESLVDYNLNENKTAEAPIDYWGEWPDHEYHPSPDNWRFPIYTIFLDRIANGDPKNDDINGTAFEHVVGSNQMRHGGDLVGLIDTLDYIRGMGFKGIYFAGTYLMNLPWAYDGYSPVDTTLLDMHHGTLEDWRRTITEIHKRDMYVIMDNTLATMSNLIGFKGHLNDSADFRADEYEVQWISDRQYADFKFGNEYNETCNFPKFWNETGYPLTSGGVEELKGCYNSDFDQFGELEAFGNFPDWKRQLTKFASVQDRLREWHKPIRDVITKHSCIQIASLDIDGFRFDKAVQATLEPLSEITAVYRECAKKYGKHNFFLPGEITSGNTFGSLYLGRGRQPDQQPESADAGAKLKNSSDGYFLRDDGYQALDSAAFHYTIYRSMTRFLGMDGNLVAGFDLPTDFIEAWNGMLVSNDFLNAYTGEVDPRHMFGVSNQDNFRWPAIRNGTEKYLLGLYIVTLELPGIPLILWGEEQAMYVFESTASNYLFGRQPMTYQTAWWTHGCMTLNTSKFYDFPNEKGLHGCEDITVTYDQRNPAHPLRNIMKRMFEIREQYPVANDGFYLQTLSQLTKDVYLPGSADTPTVTGLWSVLRSYFPGVQKEASKNSQNLWLKDTALLSPFKSGTKLKNLFYPYDELTLEDGPGEVAVHNSTESYGCIRSMKLLPWEYRAYIEAENFVEPGPTVTEFVPGHDARLLSTDDSGQTVDIQLGYSKEMDCDKIADAISLNSTTVKGVTASLDTSSVSCNKISARTSSDNFVGEVPTVWTWSAKLKNVHHGIHQLTVKNVSTTSGVHTDAVDQFLFRVGSQNNPLLSPLSNYSTSLVQKSDNGSFYIQHDAAGADKFRYSTDFGLNWSNWTTYTGDNTLVNFPEWTGTDAQKWKGTHIRVQYFSRLTGSSDYIQEGDHGWEKGVARRFPNLFWNGPFNQYGYDAGLDNKMRYDTKEHRWKYDFVYEWPAIGQMSVWGMLKDGRPDVTEVYGDVDNSSVVQKLPPSYLSSNVINITKLPPFPHLGWTITLNDANLRYEMLPVGSGWAQLVLYILLWVLPILMGFAGIFIFIRTFYRVKLNTDGDVAKEDKLPLLFWRRVREKFSGDDESDKSISDKDIPTDIAIAGAPEQRRTVLIATMEYNIEDWKVKVKIGGLGVMAQLMSQHLKHQNLIWVVPCVGDIEYPQDTPSEPFVVTILDKPYFINVQYHIVDNITYVLLDAPVFRQQTKAEPYPPRMDDLDSAIYYSAWNQCIAETIKRFPSIDLYHINDFHGCLAPLYLLPTRTIPVCLSLHNAEFQGLWPLRNPHEKKEVCSVFNLPIETATKYSQFGNVFNLLHTGASYVRFYQRGFGAVGVSKKYGKRSWARYPIFWSLEKIGSLPNPDPSDTGDMTNNPDAEVPIQSYEERINDKLQAQKWAGLNEDRDADLLVFVGRWSKQKGVDLIADVMPAILSARPHVQLICVGPIVDLYGRLAATKLERIMEMFPGRVFSKPEFTVLPPYVFSGADFALIPSRDEPFGLVAVEFGRKGALGIGSRIGGLGQMPGWWYTVESDATRHLLHQLKTAIKQALDSSQEAREEMRANSVRQHFPVLEWIQKLEALQRTAIQIHHTKNKNTVTGPMPESQNYWETQSVRMSTLGLPGPTQSMTEGLDTPPDRLLMPGQSRFTELQLEGADGNRNSSLGRKLSLGRRSGPGQDRKRLGKSPPRESQILGEDLEGENTDAEEEGTATPHVNYISPEEAMAAVNNTLGTQDIGTAHTNNSTHSLAGPQGSTYMSAPGSPNNMSRASSPMPGTPALPQYPFQLALGSGGNTPFAHSRNVSMLSLPSVVADHNQPVFELQKVDPTFTDSTRHFTRRFEEILNNLNKKNSMTDCCIETYLMKSERKFYSMYNDAQLKKQPDDRAVSDSNSDTQDNRASYATVTGGSDSNDPDEIDLWLSRLGYKRPIAIQRFMRRRLGKWPVYALFLGLGQIIATNSAQMTLLVGQVGETATKLYIIATIYCISSICWWLLFYRFPSVIVLTLPWFIYCMAFIIIGVSPFALTSLGRAWAQNVAAGVYSAASSSGSLFFALNFGDQGAVPIKDWMFRASLIQGIQQLYTVALWYWSSKVTEAEVGGVSTAALSSWKLTAVVMPIAAVCFIVGVLLALGLPKYYRQSPGRILFFYTSLFRRRIVLWFFFMVIVQNWFLSAAFGRNWSFLWSSQHAKAWEVVILVIFFFVILWVIILIIFRALSKEHSWILPVFGLSLGAPRWAQTWWGTSNIGYYLPWAGSLTSGALVSRCVWLWLGVLDEIQQVGLGMILLQTLTRVHVCFVLLAAQALGSIATICARGFAPNKLGPAGISPNVGTSLDTVGNAWFWIALFFQLLASWGFLLFYRREQLNRP

SEQ ID NO: 16 - DNA, 7370 bp, Aspergillus sojae
atgttcctcacggtgatgcagcgctcagcgattcttatcctgtcgttactgagcgctaccgccttaagctggccctacactgagtcgctcgttgattataacttgaatgaaaataaaaccgccgaagcgccgattgattattggggagagtggccggatcatgaatatcacccgtcgcccgataactggcgcttcccgatctataccatctttttggaccgcatcgctaacggtgacccgaagaatgatgatattaatggcaccgcctttgagcatgtggtgggctcgaatcaaatgcgccacgggggcgatctagttggtctaattgatacgctggattatattaggggcatgggtttcaaggtgtgttaagccggttgtgatccgatcttggtgcttactatagtagggtatttacttcgctggaacgtacttgatgaaccttccctgggcctacgatggctactcaccggttgataccactttgctcgacatgcaccatggcacactcgaggattggagacggaccatcaccgagatccacaaacgagatatgtatgtgatcatggataatacactggcaacgtaagtacataccccagatgtctcagatcaacactggttgacaagtatatgcagaatgagcaaccttattggcttcaaaggacatctaaacgattcagccgattttcgagcagatgaatatgaagtgcagtggatctcagatagacagtacgcggacttcaaattcggaaatgagtacaatgagacctgcaacttcccgaagttttggaatgagaccgggtacccgttgacatcaggtggtgtcgaggagctgaaagggtgttacaatagtgatttcgatcaatttggagaactggaggcgttcggtaactttccagactggaagcgccagcttaccaagttcgcctcggtgcaagatcgtctgcgcgaatggcacaagcctattcgtgatgtcatcaccaagcattcttgcattcagatcgccagtctagatatcgatggttttcggttcgataaagccgtccaggcaaccctcgagcccctaagtgagataaccgctgtctatcgtgaatgtgcgaagaaatatggcaagcataactttttccttcccggcgagatcacatcaggaaatacctttggcagtctttaccttggacgcggtcgtcagccagatcagcagcctgaatcagcagatgctggtgctaagttgaagaatagttcggacggatattttctcagagatgatggataccaggcgttggactcagccgcgtttcactacacgatctaccgttcgatgactcgtttcctgggaatggatggtaatctagtggctggctttgacttgcctactgattttatcgaggcctggaatgggatgctcgtcagcaacgacttcctcaatgcatacacgggtgaagtagacccgaggcacatgtttggtgtctcaaatcaggacaactttcgttggccagcaatcaggaatggcaccgagaaataccttctgggtctttatatcgtcaccctggagctccctgggattcctctgatcctatggggcgaagagcaggcgatgtatgtttttgaatctactgcttctaactacctgttcggccggcagccaatgacgtatcagactgcatggtggacgcatggatgcatgactttgaatacatctaaattctacgatttccctaatgagaagggactacacggctgcgaggatatcaccgttacgtatgatcagcggaatccggcacaccctctgcgcaatatcatgaagcgcatgttcgaaattcgggagcagtatccggtagcaaatgatgggttctatcttcaaacgctttctcagctgacaaaggatgtgtacctccctggttcagcggacactccgactgtgactggtttatggtcggttctgcggagctacttcccaggcgtccagaaggaggcaagcaagaacagtcagaatctttggcttgtgtatcataatgctaacaaaactgaaacctacggtggtgactgcaaaaagaaagataccgccttgctgtcgcctttcaagtcgggaacgaagctaaagaatctcttctatccttacgatgagctcactttagaagatggtccgggcgaagtcgcagtccacaacagcaccgagagctatggatgcatccgcagtatgaaattgcttccgtgggaataccgtgcctacatagaggccgagaacttcgttgagcccggccctactgttactgagttcgttcctggccatgacgcccgattgttgtctacggatgacagtggccaaactgtcgacatccagctcggatattcaaaagagatggactgtgacaagatcgccgatgccatctctttgaactcaacgacagtgaagggagttacagcttcccttgacacatctagcgtgtcttgcaacaaaatctccgcaaggacaagcagtgataactttgttggggaggttccaaccgtttggacctggtctgccaagctgaaaaatgtccaccacggaatccatcagctgacggttaagaacgtttccacgacgtctggagttcataccgatgcggttgaccagttcttgttccgtgtcggaagtcaaaacaatccccttttatccccactgtccaattattccaccagtcttgtgcagaaatccgacaacggcagcttctatatccagcatgacgccgctggggctgacaaattccgctactcgactgattttggccttaactggtccaactggacaacgtataccggtgacaacaccctagtcaacttcccagagtggaccggaacagacgctcagaagtggaagggaactcatattcgcgtacagtacttttcaaggctcaccggcagtagtgattacattcaggaaggtgatcacggctgggaaaaaggtgttgctcgaagatttcctaacctcttttggaacggtccgttcaatcaatatggttatgatgcgggactggataacaagatgagatacgataccaaggaacatcgttggaagtacgattttgtctacgagtggccggccattggacaaatgagtgtctggggaatgttaaaggatgggcggcccgacgttacagaggtgtatggtgatgttgacaactcatctgtagttcagaaacttcctccgtcttacctgtcgtccaacgtgatcaatatcacaaagctgcctccattcccgcacctcggctggaccatcacgctcaatgacgccaacttgagatatgagatgcttccggtcggatctggatgggcccagctcgtgctatacattcttctttgggtgcttccaattctcatgggatttgctggtatcttcatcttcatcaggacattctaccgtgttaaactcaataccgatggcgatgtggctaaagaagataagctgccgctcctgttttggcggagggtcagagaaaagttctccggcgacgacgagtcggataagtcgatatctgataaggatataccgacagacattgctatcgcgggagcccctgagcaacgacgtactgtattgatcgccaccatggaatacaacatcgaagactggaaggtcaaggtcaagatcggcggtctaggcgtcatggcacaactcatgtcccagcatctgaagcatcaaaacctgatctgggttgttccttgcgttggtgacattgaatatcctcaggacacgccatccgagcctttcgtggttactatcctggacaagccatattttatcaatgtgcaatatcacatagttgataacatcacctatgtcctgctcgacgctccagttttccgccaacagaccaaagcagagccgtatcctcctcgcatggatgatcttgacagtgcaatctactattcggcatggaaccaatgtatcgcagagacgatcaagcgattcccgtcgatcgatctctatcatatcaacgatttccatggttgtttagcaccactgtatttgcttcccacacgtaccatcccggtgtgcctgtccttacataatgctgaattccagggtctgtggcccctgagaaacccccacgaaaagaaggaagtctgttcggtcttcaaccttcccatcgaaactgcaaccaagtacagtcagtttggaaacgtcttcaaccttcttcacaccggtgcaagctacgtgcgattctaccaacgcggtttcggcgcagtaggtgtgtccaaaaagtatggaaagcgctcatgggctagatacccgattttctggagccttgaaaagattggcagtcttccaaacccagatccctccgatacaggggatatgacaaataacccagacgccgaggtcccaatccagtcctacgaagaacgaatcaacgataagctgcaggcccagaagtgggctggtttgaatgaagatcgtgacgctgacctacttgtgttcgtcggacgatggtcgaagcagaagggagtggatttgattgcagatgtcatgccagcgatattatccgccagaccccacgtgcaattgatttgcgttggacctatcgttgatctctatggtagactagctgctacaaagctagagcgcatcatggaaatgttccctggtcgcgttttctctaagccggagttcaccgttttgcctccatacgtattttctggtgccgacttcgccctgattccctccagagacgagccatttgggttagtcgctgtagaattcggccgtaagggtgcactgggaatcggctctcgcatcggaggtctaggccagatgccaggttggtggtacaccgtggaatccgacgcaacccgccatcttctgcatcagttgaagaccgctataaaacaagcgttggactcatcacaagaagctcgtgaggagatgcgcgccaattccgtcaggcaacatttccccgttcttgaatggattcagaaactcgaagccttgcagcgaacagcaatccaaatccatcacaccaagaacaagaacaccgtgacaggcccgatgccagaatcgcagaattattgggagactcaaagcgtacggatgtctacgctgggccttccagggcctacccagtcgatgacagagggtttagatacaccgccagacaggcttttgatgcccggccagtctcgatttacagaactgcaattggagggagctgatggcaacaggaacagtagcctgggtcgcaaactctcgctcggtcggcgatctggacctggtcaggacagaaaacgtctcggcaagagcccaccgcgcgagagccagattcttggcgaggatctggaaggtgagaacacggatgccgaagaagagggcaccgctacgccgcatgtgaactatatttcgcctgaagaagctatggctgcagttaacaacactttgggaactcaagatatcggaacggcacacacgaacaacagtactcactcgctcgcaggtcctcaaggatctacttacatgtccgcgccaggctcaccaaacaacatgtcaagggcttcctctcccatgccaggaaccccggcgctgcctcaatacccattccagttagcattgggttctggcggaaatactcctttcgctcactcccgcaatgtgtccatgctttccttgccttcagtcgtggcggaccataaccagcccgtttttgagctgcaaaaggttgatccgacctttacagacagcacacgccacttcacgcgacgcttcgaagagatcctcaacaacttgaacaagaagaactcaatgacagactgctgtatcgagacgtacctgatgaagagcgaacgtaaattctacagcatgtacaacgatgcacaattaaagaaacagcccgatgatcgtgcagtatctgattcgaattcagacactcaagataaccgcgcctcatacgccactgtcactggaggttcggactcaaatgatccggatgagattgatctatggctctctcgactggggtataagcgaccgattgctattcagagattcatgagaaggcgtctcggcaaatggcctgtttacgctctattcctgggtcttggacaaatcatcgcgaccaactccgctcaaatgaccctgttggtcggtcaggtaggagaaacagcaacgaagttgtacattatcgcaacgatctactgtatttcctccatctgttggtggctcctcttctatcgattcccgtcagtaatcgtcctcactctcccctggttcatttactgcatggcattcatcatcattggcgtctctccattcgctctcacatctctcggtcgagcctgggcccagaatgtcgctgcaggtgtgtattccgccgcatcatctagcggctcgttattcttcgccctcaacttcggtgaccagggtgccgtccctataaaggattggatgttccgcgcgagtctcatccagggaatccagcagctctataccgtcgccctatggtactggagttcgaaggtaaccgaagcagaagtgggaggcgtgtccaccgctgctctaagctcatggaaactcacagctgtggtgatgcccatcgccgcagtatgtttcatagtcggcgtgcttctcgcgctcggcctaccaaaatactaccgtcaatcccccggtaggatcctcttcttctacacatccctcttccgccgccgtatcgtcctctggttcttcttcatggtgatcgtccagaactggttcctctccgcagcattcggtcgcaattggtcattcctctggtcctcccagcacgccaaggcatgggaggttgtcatcctagtcatcttcttcttcgtcatcctctgggtaatcatcctcatcatcttccgcgccctgtccaaggaacacagctggattctacccgtcttcggcctgagtctcggcgcaccgcgctgggcccaaacatggtggggaacgtccaacataggctactacctgccatgggcaggaagtctgacatccggtgccctcgtgtcgagatgcgtctggctctggctcggtgtccttgacgaaatccagcaagtcggcctgggtatgatcctcctacagaccctgacaagagtccacgtgtgctttgttctgttggccgcacaggctcttggatccatcgctacgatctgtgcgcgtggattcgcgccgaataagctcggtcctgcgggtatctcgccaaatgtgggcacgtctttggatacagttggaaatgcgtggttctggatcgcgctcttcttccagcttctggctaggtaaggcttttgaattttacggctttaataaattcaatactaatgtgatttatagttggggcttccttttgttctatcgtcgtgagcagcttaataggccttaa

SEQ ID NO: 17 - protein, 2425 aa, Aspergillus niger
MKWAISGTLLACFATTATAWPYDESLVDYNFNQNQSATNPADYWGTWPNHTGDYFPSPDNWRFPVYTLFLDRFVNGDPTNDNINGTLFEHDLRSNQMRHGGDVAGLLDTLDYLQGMGIKGLYLAGTILMNQPWGSDGYSALDTTLLDQHYGNLQTWRNAITEIHKRGMYVIFDNTIATMGDLIGFDGYLNTTTPFSVKEHQTVWKTDRRYVDFDIGNDYNETCDYPRFWFEDGYPVQASVTEELVGCYNSDFDQYGDIEAFGVFPDWQRQLAKFASVQDRLREWVPSVRERLIRHSCIIIQSLDIDGFRYDKATQATVDALGDMSNAYRECARAVGKENFFIAGEITGGNTFGSIYLGRGRQPNQFPDSAEAAMKLTNTSDAQYFLREVGHEAIDGAAFHYSIYRALTRFLGMDGNLAAGYDVPVDWVDAWNLMLQSNDLVNANTGKFDPRHMYGATNQDVFRWPTVEKGVERQLLGLYITTLLLPGIPLLLWGEEQAFYVLDATASNYIYGRQAMSPATAWRDHGCFSLESSQYYNWPIESGRQGCHDPTVAYDHRDPSHPVRNIIKHMYQMREQFPVLNDGYTIQKLSNHTEDVYYLGSNGTATETGLWSILRDVNADVQDLGSDAKNQPVWLVYHNTNRTIDYKFDCSDNDTALIAPFDSGTWVKNLFHPYDEHQLIDSPTKLGLNGSTAYSGCLANMTMSAYEFRAYVPKTRFTKPRPMITKFTPGHDVPIRSTVAPNADENVEVEIYFSEEMDCDSVTKSITLSSSTEIGKAPSVDSGSVNCKSVPATNTSWTGQIPGVWMWAANLTGVYNGIHRLTVNNVSTESGNATTNAVDHFLFRIGQIDNPMIFSSANYSTSLLHKESNGTLFIQHHAAGADKYRYSTNWGTTFSDWIDYRGGNDTIEELEWSGTKKQSWKGNHVRVEYWSRWTGSSDYVQEGDAGWNENVPRRFPHVFFNGPYNQYGYDAGLDNVVRQDSVDGLWKYHFTAEWPAQAQLNIWGMNPDGEPDQSWVLGDADNDSVLDRMPPSSLSATLINITEHPPSPYISWNIFIDDGTMRFQLFPVGHQNTQIAMYVLFWIIPVITGAAGVWAFMKSFYKVKFNQVGVSEKHQMIPLALRRKFKRNRNRGGDEENSNPLMRLANKSGFLQTDTAIGGAASGKRRMVLIATMEYDIEDWAIKIKIGGLGVMAQLMGKTLGHQDLIWVVPCVGGVDYPVDKPAEPMHVTILGNSYEVQVQYHVLNNITYVLLDAPVFRQQSKSEPYPARMDDLNSAIYYSAWNQCIAEACKRFPIDLYHINDYHGSLAPLYLLPDTVPACLSLHNAEFQGLWPMRTQKEKEEVCSVFNLDIETVRHYVQFGEVFNLLHSGASYLRVHQQGFGAVGVSKKYGKRSYARYPIFWGLRKVGNLPNPDPSDVGEWSKEQASAMGDNVSVDPTYEAGRGDLKRQAQEWAGLEQNPDADLLVFVGRWSMQKGVDLIADVMPAVLEARPNVQLICVGPVIDLYGKFAALKLDHMMKVYPGRVFSRPEFTALPPYIFSGAEFALIPSRDEPFGLVAVEFGRKGALGIGARVGGLGQMPGWWYNVESTATSHLLVQFKLAIDAALSSKTETRAMMRARSAKQRFPVAQWVEDLEILQTTAIQVHNKELVKHNGRPFTPSGTTTPGGILSQPSSPLMPPGMQTPLAHSRESSYSNLNRLSEYVTDPKTNYSRDISPSGTEKPRSGLQRQLSLGVRSGPGHQERRGRRGRQRDSIPEHEDTAGAMTDVEEDHEDIGDQQDADDEYTLTPAQVEEGRRLQAVQQQGVGMPTSPGVRRYSQDSLHPRQLPSSPGPVPPPTQSLLPPPRLGDAGSRLSSASVLSLDSVVGTKTDFKLQKVDPFFTDSTGEYYKAFDKRLVGLNGSNSESQLCIEEYLIKSEKEWFDKFRDARLGRLKSPASSVFRDKHGASPVGSYYDDTGSRVSGDYDRESRDTEDDEFLLGKDYVPPTGLRKWMQIRVGDWPVYSLFLALGQIIAANSYQVTLLTGEVGETAEKLYGIATTYLITSILWWLVFRYFKSVVCLSAPWFFYGLAFLLIGSAHFEPNSFNRGWIQNIGSGCYAAASSSGSIFFALNFGDEGGAPVETWIFRACLIQGIQSAYIIGLWYWGSTLTKASSQGLLTSTNNIANSWKMTAICYPIAIFLWAVGLLLLFGLPNYYRQTPGKVASFYKSVFRRKIVLWNFVAVILQNFFLSAPYGRNWGFLWSSNHAKAWQIVILCIVFYGFVWAGFLFVVSRYFKSHSWFLPVFACGLGAPRFIQIWWGVSGIGYFLPWVSGGYLGGALASRSLWLWLGVLDSIQGLGFGIILLQTLTRMHMLFTLICSQVLGSIATICARAFAPNNVGPGPVSPDPTFGGSAVANAWFWVALFCQLLVCAGFLLFFRKEQLSKP

SEQ ID NO: 18 - DNA, 7680 bp, Aspergillus niger
atgaagtgggctatttccggcacgctgctcgcctgtttcgcaacaactgcaacggcctggccttacgacgagtccctcgtcgactacaacttcaatcagaaccagtccgctacgaacccggcggactattggggaacatggcccaatcataccggggactacttcccctccccggacaattggcgcttccccgtctacaccctctttctcgaccgcttcgtcaacggtgaccccacaaacgacaacatcaatggcaccctgttcgaacatgacctccgctcgaatcagatgcgccatggtggcgatgttgccggcctgctggataccttggattacttgcagggcatgggaatcaaggtcggtccctgtggcttgtccgatgctgcgatcaattactgacgatggtttagggtctctatcttgccggaacaatcctcatgaaccagccctggggatctgacggttattcggctttggacacgacattgttggatcaacactatggtaacctgcagacgtggcgcaatgccatcacggaaattcacaagcgcgggatgtatgtcatcttcgataacaccatcgcaacgtaagtttgccgctgccttttcccctctttcctacccaacaaactaacctgcaatttttaggatgggtgatttgatcggatttgatggctatctgaacaccaccacccccttctccgtgaaggaacaccaaacggtgtggaagactgaccgccgctatgtggacttcgacattggcaatgactacaacgagacgtgcgactacccccgcttctggttcgaggatggctaccccgttcaagcgtcagtcaccgaggagcttgtcggatgttacaacagtgatttcgaccagtacggtgatattgaggcctttggtgtcttccccgattggcaacgtcagctggcaaaattcgcctccgttcaggatcgactccgtgaatgggttccctccgtgcgcgagcgtttgatccgccactcctgcatcattattcagtcgctcgatattgacggtttccggtacgacaaggcgactcaggcaaccgtcgacgccctcggagatatgtccaatgcgtaccgcgagtgcgcccgcgccgtaggaaaagagaacttcttcattgcgggcgaaatcacgggtggtaatacctttggttccatctacttgggccgaggaagacagcccaaccagttccctgactcggcggaggcagccatgaagctgaccaacacttccgacgcccagtatttcctgcgtgaagtgggacatgaggcgattgatggtgcagccttccactactccatttaccgagcgctgacccgcttcctgggcatggatggtaacttggctgccggttacgatgtgccagtcgactgggttgatgcctggaatctcatgctgcagtccaacgatctggtcaatgcgaatacaggcaagttcgacccccgccacatgtacggggctaccaaccaggatgtcttccgttggcccacggtggaaaagggcgtggagcgtcagttgcttggattgtacatcacgactcttctgctccccggaattccgctccttctctggggcgaggaacaggcgttttacgtactggatgccacggcatcgaactacatctacggtcggcaggccatgtctcctgccaccgcatggagggatcatggctgtttctccttggaatcgtctcagtactataattggcccattgagtccggccgtcagggctgccacgaccccacggtggcctacgatcatcgtgacccgtctcatcccgtgcgcaatatcattaagcatatgtatcagatgcgcgaacagttccccgtcctcaatgacggctatactattcaaaagctctcgaaccacaccgaggacgtgtactatctcggttccaacggcacagccaccgagaccggactctggtcgattcttcgtgatgtgaacgcggatgtgcaggatttgggctccgatgcgaagaaccagcctgtctggctggtttaccacaacacgaaccgcaccattgattacaagtttgactgctcggataatgatacagctctgattgcccccttcgatagtggcacctgggtcaaaaacctgttccacccgtatgacgagcaccagctgatcgattcccccaccaagttgggattgaacggatcaactgcatacagtggctgcttggctaatatgaccatgtccgcctatgaattccgggcctacgtgcctaaaacccgctttactaaacccaggccgatgattacaaagttcactccgggacacgatgtcccgatccgctcgaccgtggccccgaacgcagacgagaacgtggaggtcgaaatttacttctccgaagaaatggattgcgactcggtgacaaagtccattaccctttcgtcatcgaccgaaattggaaaggccccctctgtcgattctggcagtgtcaactgcaagtcagtccccgccactaacaccagctggaccggccagattcccggggtgtggatgtgggcggccaacctgacaggtgtgtacaacggcattcatcgtctcacagtcaacaatgtcagcacagagagtgggaacgcaaccaccaacgccgtcgaccatttcctcttccgcatcggccagattgataatccgatgattttcagcagtgcgaactattcaactagtttgctccataaggaatccaacggcacccttttcatccagcaccacgccgcgggtgctgataagtatcgctattctacgaattggggtaccactttctccgattggattgactacaggggcggaaatgacactattgaggaactcgaatggtcgggaaccaagaagcagtcatggaaaggaaaccacgttcgcgtggagtattggagtcgttggaccggcagcagcgattacgtccaagagggagacgcgggctggaacgagaatgttccacgccgtttccctcacgtcttcttcaacggaccctacaaccagtatgggtatgatgcaggtctggacaacgtggtccgccaggacagcgttgacggtctctggaaatatcatttcaccgcggaatggcctgctcaagctcaattgaacatttggggtatgaaccctgatggggagcctgaccagagttgggtcctgggagatgccgataatgattcggttctcgatcgcatgccgccctcttcgctgtccgcgacattgattaacatcactgaacaccccccctctccctacatttcgtggaatatcttcattgatgacgggaccatgcgcttccagctgttccccgtcgggcatcagaatactcagatcgccatgtatgtgctcttttggatcatccccgtcatcacgggcgcagccggtgtgtgggctttcatgaagtctttctacaaggtcaaattcaaccaggttggtgtgagcgaaaaacaccagatgatcccattggccttgcggcggaagttcaagcgcaatcgcaatcgtggcggtgatgaggaaaactcaaaccctctcatgcgtctggcgaacaagtccgggttcctccagactgacacggcgattggtggtgctgctagcggcaagcgtcgcatggtcctgatcgccaccatggagtacgacattgaggattgggccatcaagatcaagattggtggtcttggtgtcatggcgcaactcatgggtaagactctgggtcatcaagacttgatctgggtggtgccttgcgttgggggtgtcgattaccccgtggacaaacccgcagagcccatgcatgtcaccattcttggcaattcgtacgaggtccaggtccagtatcacgtcttgaataacatcacctatgttctgctggatgcccctgtgttccgtcaacagtctaagtcagagccttacccggctcgcatggacgacctgaacagcgccatttactactcggcctggaatcagtgcattgcggaagcctgcaagagattccctatcgacctgtatcatatcaacgactaccatggttccctggctccactgtatctacttcctgacacagtacctgcctgtctttccctgcataacgccgagttccaaggtttgtggcccatgcggacgcagaaagaaaaggaggaagtttgctccgtgttcaatctggatatcgagaccgtgaggcattacgtgcagtttggagaggtgttcaacttgctccactcgggtgctagttatctccgtgttcaccaacaaggtttcggtgctgttggtgtgtctaagaagtacggaaagcggtcctacgcgcgttaccccattttctggggtctccgcaaggttggaaacctacctaaccctgatccgtctgatgtcggtgagtggagcaaggaacaggccagcgccatgggtgacaatgtgagcgtggacccgacttatgaagccggtcgaggcgacctcaagcgtcaagctcaggagtgggccggtcttgaacagaaccctgacgccgatttgcttgtcttcgttggtcgttggtcgatgcagaagggtgttgatttgatcgccgacgtcatgcctgctgtcctggaagcacgccccaatgttcagctcatttgtgttggaccagttatcgatctctacggtaaattcgcggccctcaaactcgatcacatgatgaaggtctaccccggacgagtgttctctagacctgagttcacggcattgcccccctacatcttctctggtgctgaattcgcgctgattccctctcgtgacgagcccttcggtctggtcgccgtcgagttcggacgtaagggagctctgggtatcggtgcccgggttggtggtctcggtcagatgccaggttggtggtacaatgtggaatcgacagctacctcccatttgctcgttcagttcaagctggctatcgacgcggctctcagttcgaaaacggaaactcgtgctatgatgcgtgcccggtccgccaaacagcgcttcccggtcgcccagtgggtggaagacttggagatcctgcaaaccaccgccatccaagtgcacaacaaggaattggttaaacataacggtcgacccttcaccccgtctggaactaccacgccgggtggcatcttaagccagccgtcaagtccactaatgccccctggaatgcagactcccttggctcattctcgggaaagcagctattctaacctgaaccgtctcagtgaatatgtcacagatccgaaaacaaactacagtcgagacatcagccccagtgggacggaaaagccgcggtccggcctgcaacgacagctttctcttggtgttcgctcaggacctggtcatcaagagcgccgtggccgtcgtggacgccagcgcgacagcatccccgaacacgaagacaccgcaggggccatgaccgacgtcgaagaagaccacgaggacattggggatcagcaggatgcggacgacgagtacactctcaccccggctcaggtcgaggaaggacgtcgcttgcaggctgtccagcagcagggagtgggtatgccgacgagtccgggcgtccgccgttatagtcaagactccttgcatccgcgacagcttcctagcagccctggccccgtcccacctcctacacagagcctccttccgccacccaggcttggggatgccggtagccgactcagtagcgcgtctgtcctgtccctggattcggtcgttggtaccaagacggacttcaagctccagaaggttgaccccttctttacggattctactggcgagtactacaaggcattcgacaagaggctggtcggcttgaacggctcgaactccgaatcccagctttgcattgaggaatatctcatcaagagtgagaaggaatggttcgacaagttccgcgatgcccgactgggtcgtctaaaatcccccgcgtcgtctgtcttccgggacaagcatggtgcctcccctgttggctcctactacgatgatacgggctcccgggtgagtggtgactatgaccgggagtcccgcgacacggaagatgacgagttcctcctgggcaaggactacgtgcctccgacgggtctgcgcaagtggatgcagattcgtgttggagactggccagtctactcgttattccttgccttgggtcagatcattgcagccaactcttatcaggtgaccttgcttaccggtgaggttggtgagacggccgagaagctctatggtatcgcaaccacctacctgatcacctcgatcctttggtggcttgtgttccgttacttcaaatcggtggtgtgcctctcggctccctggttcttctatggccttgccttccttctgatcggctccgctcactttgaacccaattcattcaaccggggttggatccagaacatcggaagtggatgttacgccgctgcctcgtctagcggttccatcttcttcgccttgaactttggtgacgaaggtggtgcgccggtcgaaacctggatcttccgggcttgtctcattcagggtatccagtcggcttatatcatcggactgtggtattggggttccactctgaccaaggcatccagccagggtctgttgacctcgacgaacaacatcgccaatagctggaagatgacgtgagtacattgaaccctctgattgttcatcaatcagccagtcattccatcttgtgacccgctaacactgatctcctctagtgccatctgttacccgattgcaatcttcctctgggctgttggattgctgcttctctttggacttcctaactactatcgccaaaccccgggcaaagtggcctccttttacaagtccgtattccgccgcaagatcgtcctctggaacttcgttgccgtcatcctgcaaaacttcttcctcagcgcaccgtacggccgcaactggggctgtaagtctaactttccctgccacatcgtgtcgaattgataagctaactctagtccgcagtcctttggtcttccaatcacgccaaggcctggcaaatcgttattctctgtatcgtcttctacgggttcgtctgggcgggcttcctgttcgtcgtcagccgctatttcaagtcccacagctggttcctgcccgtgtttgcgtgcggacttggagcacctcgcttcattcaaatctggtggggtgtctcgggcatcggttacttccttccctgggtctccggaggctatctcggcggagctttggcctcgaggagtctctggctctggctgggcgtgttggattccatccagggtctcgggttcggtatcatcctcctgcagaccctcacccgcatgcacatgctgttcaccctgatctgctcgcaggtgcttggttccattgccaccatctgtgcgcgggcgtttgccccgaataacgtcgggcccggccctgtgtcgccggaccctacctttggaggaagtgcagtggccaatgcgtggttctgggtggccctgttttgtcagctgttggtgtgtgctggcttcctcctcttcttccggaaagagcagctttccaaaccttgaacgccttaatgatgtggtggtgcgcttgggcaccaccgggcatgaacatttaacatacgtcccaccattccttccttccttccctccctacctacgccccttggatataattttactgtctgtcataatataatctctcctgtatgta

SEQ ID NO: 19 - protein, 2420 aa, Aspergillus fumigatus
MKWGWTGALLAWFATTTSCWPYDESLVGYNLNENKEAKSPVEYWGEWPDHKGKYFPSPENWRFPFYTLFLDRFVNGDPENDNINGTQFEHDISSNQMRHGGDVAGLVATLDYLQGMGIKGIYLAGTILMNQPWGADGYSTLDTTLLDQHFGNIDTWRNAITEIHKRGMYVIFDNTIATMGDLIGFEGYLNTTTPFSVKEHKALWKTDRRYVDFDIGNDYNSTCDYPRFWYEDGLPLPSEQADQLVGCYNSDFDQYGDIEAFGVFPDWQRQLAKFASVQDRLREWIPSVRERLIRHSCIIIASLDIDGFRYDKATQATVDALGEMSMAYRECARAVGKNNFFISGEITGGDYFGSIYLGRGRQQNQWLPDPSQGPKMTNESSAQYFLREAGHEALDSAAFHYSVYRTLTRFLGMDGNLAAGYDVPLDWVDMWRQMLRSNDLVNANTGKFDPRHMYGATNQDVFRWPTVQWGVERQLLGSYITTLLLPGIPLLLWGEEQAFYVLDATATNYIYGRQAMSPATAWRDHGCFSLNSSQYYKWPIQAGREGCHDDTVAYDHRDPSHPVRNILKHMYQLREQFPVLNDGYTLNNLSKSTFPVQYPGSNGTETETGMWSVSREANLEVQDFGSDDLNSPVWMVYQNDNHTVDYKFDCNSETDALIAPYPADTVVKNLFYPWDEFTLTAGPTKRTFGNATLPAGCYGNLTLKAFEFRAYVPKKLHRKPRPMITKFSPGHDVPIASTVAPDASENVPIELHFSEEMDCDGVTKSISLTSSTESLKVPSIDAGSVHCERITNFNTSWTAQIPSMWKWQATLTNVYNGIHQITVKEPKTSSGNASTNSTDHFLFRIGQVDNPMVFTRANYSTSLLHEYENGTLFIQHHAAGADKYRYSTNWGTTWSSWTKYHGGNDTIEELPWQGTKEQRWEGKHVRVEYWSGLTGSSDYYQEGDVGWPHQVPRRFPHIHFNGPFNQFGYDGGLPNKLKLDTTTGHWKYHFTYEWPAQAQINVWGMNPDGRPDQSWVLGDIDGDHVLDRMPPSSLSATMINITDLPPSPHLAWIISINDGTMRYTLEPTGDQSTQMAMYILFWIVPLLTGAVCVYVFMKSFYQVKFNQVGVSEKRTLIPLALRRKLKRARNGEGEAMNPLMRLANKSGFLQSATDLTAASGGSKRRMVLIATMEYDIEDWAIKIKIGGLGVMAQLMGKTLGHQDLIWVVPCVGGVDYPVDRPAEPMIVTILGKPYEVQVQYHILQNITYVLLDAPVFRQQSKSEPYPPRMDDLDSAIYYSAWNQCIAQTIKRFPIDLYHINDYHGSLAPLYLLPQTIPACLSLHNAEFQGLWPMRTEKEKEEVCSVFNLDKEITRRYVQFGEVFNLLHAGASYLRVHQQGFGAVGVSKKYGKRSYARYPIFWGLKKVGNLPNPDPSDVGEWNKEKALAKSEDPPVDQEFEAGRAELKRQAQEWAGLEQNPDADLLVFVGRWSMQKGVDLIADVMPAVLEARPNVQLICVGPVIDLYGKFAALKLDRMMKVYPGRVFSRPQFTALPPYIFSGAEFALIPSRDEPFGLVAVEFGRKGALGIGARVGGLGQMPGWWYNVESMTTAHLLHQFKLAIEGALNSKPEVRAKMRARSAKQRFPVAQWIEDLEILQSTSIRIHNKEASKSNNRPVTPTGPMTPRGLGTMSPTFPGSGTQTPVGTHSREASYVNLRQLSEIGPQQRDTIISYSNNNAGREMTEKPAPGLSRKLSLGVRSGPGHINRPGRRGQGQQDLALPDRRDGGDVSDIEEESDEDFIDQYYGDEEYTLTPEQAEEGRRLQNNPQSQSGRATPRELTRSSQFPSSPSVHSDMGLAPPTRPFLEPGNRLSSASVLSVDSVVGDKKDFKLQKVDPFFTDSHGEYARLFENSLENLNAANSETQLCIEEFLVKSEKEWFDKFRDAKLGRLNSPAPSVFRGKRGPSPVDSYYGDDASSRMSPDDEQSQEDDEFLLGKDYVPPTGLRKWMQLRIGDWPVYSLLLGLGQIIAANSYQITLLTGEVGQTAEKLYGIATTYLITSILWWFVFRYFKSIVCLSVPWFFYGLAFLLIGLAHFDHNEFSRGWIQNVASGFYATASSSGSIFFALNFGDESGAPVKEWVFRACVIQGTQQAYVIALWYWGSTLTKASSQGLLTAETNIANTWKMTAICVPITVFLWCVGLLMFFGLPNYYRQSPGKVPSFYRSVFRRKIVIWNFAVVIIQNFFLSAPYGRNWNFLWSSAHAKTWQIVILCIVFFGFVWAGFLFVLSHLSKKHSWILPVFACGLGAPRWAQIWWGVSGIGYYMPWVAGGLTGGALASRSIWLWLGVLDAIQGLGFGMILLQTLTRMHMCFTLIVCQVLGSIATICARAFAPNNVGPGPISPDPTYGASAVANAWFWIALIFQLLICAGFLLFFRREQLAKP

SEQ ID NO: 20 - DNA, 7481 bp, Aspergillus fumigatus
atgaagtggggatggaccggggcgttgctggcctggtttgcgacaaccacatcatgctggccgtatgacgagagcctggtcgggtacaacctcaacgagaataaagaggccaaaagccccgtggagtactggggagaatggccggaccataagggcaaatactttccctccccggaaaactggcggtttccattttacaccctgtttttggatcgattcgtgaacggtgacccggagaatgataatatcaacgggacgcagttcgagcatgatatcagctccaaccagatgcgtcacggtggtgatgtcgccgggttggtcgctactttggactacttacagggcatggggatcaaagtaggttttcctgacctgactgatctgtggccgcaatgagatgctgactccgacagggcatttatctggccggaacgatccttatgaaccagccctggggcgcagacggttactcgacattggatacaacgcttttggatcagcattttggtaacatcgacacctggcgcaacgcgatcacggagatccacaagcgcgggatgtatgtgatattcgacaatactattgccacgtaagtctccccaaaccccattctctgcgtgcggactgacgcaaatacaagcatgggtgatctcattggcttcgaaggctatctcaacaccaccacccccttctcggtcaaggagcacaaggccctctggaagaccgatcgtcgctacgtggattttgacattggcaacgactataactcaacctgcgattacccccgtttttggtatgaggacggtcttccgcttccctccgagcaggccgatcagctggtgggctgctacaacagcgatttcgaccagtacggtgacattgaagcgttcggtgtgttccccgattggcagcgtcagttggccaagttcgcgtccgtgcaggatcgtctgcgagaatggatcccgagcgtgcgagagcgactgatccgtcactcttgcataatcatcgcctccctggatattgatggtttccggtacgataaagccacccaggcgacggttgatgctctcggcgaaatgtccatggcataccgggagtgtgcccgtgccgtgggcaagaacaacttcttcatctcgggagaaattaccggtggtgattacttcggttccatctacctcggacggggcagacagcagaaccagtggcttccggacccttcccagggtcccaagatgacgaatgagtccagcgcccagtatttcctgcgggaggcgggccatgaagcccttgatagtgctgcgttccactattccgtttaccgcaccttgacccgtttcctgggtatggacggcaatctcgccgccggttacgatgtccctctggattgggtcgacatgtggcggcaaatgctccggtcgaacgacctcgttaatgcgaacacaggcaagttcgacccccggcacatgtacggtgcgaccaaccaggatgtcttccggtggccaactgtgcaatggggcgtggaacggcaattgttgggtagttatatcacaacactgctccttcccggcatccctcttttgctctggggtgaggagcaggccttctatgtgctggatgccactgctactaattatatttacggtcgtcaggccatgtcgcctgcaactgcctggagagaccatggctgcttcagtctgaactcctcgcagtactacaaatggccgattcaagctggccgggaaggttgccacgatgatacagtcgcctatgatcatcgggacccttctcacccagtgcgcaacatcctcaagcacatgtatcagttgcgtgagcaatttcccgttcttaatgacggttacaccctcaacaacttgtccaagtcgacctttcccgtgcagtacccgggttctaacggaaccgagaccgagaccggaatgtggtctgtcagtcgcgaagccaacctggaagtgcaggatttcggatccgatgacctgaattcgcctgtttggatggtctaccagaatgataaccatacggtggattacaagttcgattgcaacagcgagaccgatgctttgattgctccctaccctgccgacaccgtcgtcaagaacttgttttacccctgggatgagttcaccttgaccgccggcccaaccaaacggacctttggaaatgcgacattgcctgctggctgctatggcaatctgaccctcaaagcatttgagttccgggcctacgtgccaaagaagttacatcggaagcctcgcccgatgatcaccaaattcagcccgggccacgacgttcccattgcttccacggttgcgcctgatgcttccgagaatgtgcccattgagctgcatttctccgaggagatggattgcgatggggtcaccaagtcgatttccctgacctcctccaccgagtcactcaaagtcccatccatcgacgctggctctgtacattgcgagcgtattaccaacttcaacacctcgtggactgctcagattcctagcatgtggaagtggcaggctactttgacgaatgtctacaacggtatccaccagatcactgtgaaggaacccaagactagcagtggcaacgcctccaccaactccaccgatcacttccttttccgcattggccaggtcgataatccgatggtcttcaccagagccaactactcgactagtttgctccatgagtatgagaacgggactctgttcatccagcaccacgctgcaggcgcggataaataccgctactcgaccaactggggaaccacctggtcgagctggaccaagtaccatggcggtaacgacaccatcgaagagctgccgtggcaaggcaccaaagaacagcggtgggaaggcaaacacgtccgcgtggaatactggagcggcttgaccggtagcagcgactactaccaagaaggtgatgtgggctggccccaccaagtgccccgtcgattccctcatatccatttcaacggtcctttcaaccagtttggctacgatggcggtctccccaacaagctcaagctggacaccaccactgggcattggaagtaccacttcacctacgagtggcctgcacaagctcagatcaacgtctggggcatgaaccccgatggcaggccggaccagagttgggtgctgggcgacatcgacggtgaccacgttttggaccggatgcccccgtcgtctctgtcggcgaccatgatcaatatcacggaccttccgccgtcacctcacctcgcgtggatcatctcgatcaacgacgggaccatgcggtatacgttagaacccaccggtgatcaaagtacgcagatggccatgtacattctcttctggattgtgcccttgctcacaggtgcggtgtgcgtctacgtgttcatgaaatccttctaccaggtcaagttcaaccaggtcggtgtcagcgaaaagcggacgctcattcccctggcccttcggcggaagctgaagcgtgcccgtaatggcgagggtgaggcaatgaaccccctgatgcgcctggccaacaagtccggtttcctccagagcgcgacggatctcacagccgcttcgggcggttccaaacgccgcatggtcctcattgccacgatggaatacgatatcgaggactgggccatcaagatcaaaatcggtggtctcggtgtcatggctcaactgatgggcaagaccctcggccaccaggatctcatttgggtcgttccctgcgtcggtggagtggactaccctgttgaccggcccgcggaacccatgatcgtcaccattctgggcaaaccgtatgaggtccaggtgcagtaccacatcctgcagaatatcacctacgtcctgctggatgcgccggttttccgtcaacagtccaagtcagagccctacccaccgcgtatggatgacctcgacagtgctatttactattcggcgtggaatcagtgcattgctcagactatcaagcggttccccattgacctctaccatatcaacgattaccacggatccctcgcacccctctatctcctgccgcaaacgatccccgcctgtctgtctctgcacaacgccgagttccagggtctctggcccatgcggacagaaaaggaaaaggaagaggtttgctccgtcttcaacctggataaggaaatcacccgccgctacgttcagttcggtgaggttttcaatctgctgcatgccggtgccagttatttgcgtgtccaccagcaaggattcggtgctgtcggtgtgtcgaagaagtacggtaaacgttcgtatgctcggtatcccatcttctggggcctgaagaaggtcggcaacctgcccaaccctgatccttccgacgttggcgagtggaacaaggaaaaggccctcgccaagagtgaggacccacctgtcgatcaggaattcgaagccggtcgtgctgagctcaagcgccaggctcaagaatgggctggcctggagcagaacccggacgctgatctcctcgtgttcgttggtcggtggtccatgcagaagggtgtagatctgattgcggatgtcatgcctgctgttcttgaggctcgtcctaatgttcagctgatctgtgtcggccctgtcatcgacctgtacggcaagttcgctgccctgaagctggaccgtatgatgaaggtctatcccggccgtgtcttctctcgtcctcagttcactgctctgcccccctacatcttctccggtgctgaattcgccctcattccctcccgtgacgaaccgttcggtctggtcgccgtcgaattcggccgtaagggtgctctcggtatcggtgctcgcgtcggtggtctcggtcagatgcctggttggtggtataatgtcgagtcaatgaccaccgcccatctgctccatcagttcaagctggcgattgagggtgctttgaactcgaagcccgaggtccgtgctaagatgcgtgctcgttcggctaagcagcggttcccggtcgcccaatggattgaggatcttgagatcctgcaatctacatccatccgaatccacaacaaggaggcctccaagtccaacaatcgtcccgtgactcctaccggccccatgacccctcggggactgggtacgatgagcccaactttccccggtagtggaacccagaccccggttggcacgcactctcgcgaagctagctacgtgaacctgaggcaattgtcagaaattgggccacagcagcgcgacaccatcatttcctacagcaacaacaacgctggtcgggagatgactgagaagcctgcgccgggattgagccgaaaactgtcgcttggtgtccgttccggccctggtcatattaaccgtcctggtcggcgtggacagggacagcaggacctcgctctgcccgatcgcagagacggcggagatgtttccgatatcgaggaggagagtgacgaggacttcattgatcagtactatggcgacgaggaatataccctcacacccgagcaggctgaggaaggtcgacgactccagaacaacccccagtcccaaagtggacgtgccaccccgagagaacttacccgctcctcccagttcccctcaagcccgtccgttcattctgatatgggtcttgctccccccacccggccattcctggaacctggcaatcgtctgagcagtgcctcggtgctgtccgtcgattccgtcgttggtgacaagaaggacttcaagctgcaaaaggttgatcctttctttaccgacagccacggtgaatacgctcgcctgttcgaaaatagtctggagaacctgaacgcggccaactccgagacacagctctgcattgaagagttcctcgtcaagagtgaaaaagaatggttcgacaagttccgggatgccaagctgggccgtctgaactcgcccgctccatctgtcttccgtggtaagcgtggtccttcgcctgtggattcctactacggggatgacgcctcgtcgcgtatgagcccggatgatgagcagtcccaggaagatgacgaatttctcctaggcaaggactatgtccctccgaccggtctgcgcaagtggatgcagctgcgcattggagattggcccgtctattccctgttgttgggcttaggccagatcatcgccgccaattcgtaccagatcaccttgctgaccggcgaggttggtcaaactgcggagaagctgtatggaatcgccaccacatacctgattacctcgatcctgtggtggtttgtcttccgttacttcaagtccatcgtctgtctctccgtcccctggttcttctacggtctggcgttccttctcattggcctcgcccatttcgaccacaatgagttctcccggggatggatccagaacgtcgccagtggcttctacgcgaccgcttcctccagcgggtcgattttcttcgccctcaactttggtgatgaaagcggcgcgccggtcaaagaatgggtcttccgtgcttgcgttatccagggcacgcagcaggcttatgtcattgcgctgtggtactggggttcgacgctcaccaaggcctcgagccagggcctcttgaccgccgagaccaacatcgccaacacctggaagatgaccgccatctgtgttccgattaccgtgttcctgtggtgtgtcggtctgctcatgttctttggcctgcccaactactaccgccagagtcctggtaaggttccgtccttctatcggtcggtgttccgccgcaagatcgtcatctggaactttgccgtcgtcattatccaaaacttcttcctcagtgctccttacggccgcaactggaattgtaagtcaccttcatcggtccacgtgaatgaagatcctaaccccctgttacagtcctctggagttcggcccacgcaaaaacatggcagatcgtcattctctgcattgtcttcttcggtttcgtctgggccggcttcctcttcgtcctcagccacctctccaagaaacacagctggatcttgcccgtgttcgcctgcggtctcggtgccccccgctgggcccagatctggtggggtgtctcgggcatcgggtactacatgccctgggtcgccggcgggctcacgggtggcgccctggcgtctcgcagcatctggctgtggctgggcgttctcgacgcaatccagggcctgggtttcggtatgatcctgctgcagaccctgacccgcatgcacatgtgcttcaccctcattgtgtgccaagtgctgggatccatcgccaccatctgcgcccgagcctttgcccccaacaacgtcggcccgggccctatctcccccgatcccacctatggtgcgagtgccgtggcgaacgcgtggttctggatcgccttgatcttccagctgctcatctggtaagtttttattttgcacctctatctatcgatattgaacatggctaatccattgcagtgctgggttccttctcttcttccgcagggaacagctcgccaagccctaa

SEQ ID NO: 21 - protein, 428 aa, Aspergillus oryzae
MESPRQSDASTPVEPYSPGCVDTPATQSSVLFDGNLEELLRNFPLDQYILVTGGLGFIGSHTTLELLKANYNVIVIDNLSNAFQNVFDRIKLLASKHHEQQGTKMPEMHLHAHDYRDSVALRKLLEQYQIQSRWGTPKTKISGVIHFAAHKAVEESIRNPLKYYANNVGGLIDFATTLGEFGIKTFVFSSSATVYGTLATSGLPLKEELCVHKDEIFEDRDGSKKLMEPGCTGITNPYGRTKWICEAILADLAASDPEWTIVALRYFNPVGCDESGLLGEDPKQIPTNLLPVVVKVMTGQYKELQMFGTDWDTEDGTAVRDFIHVTDLARGHIAALSAANEGKLKENFRTFNLGTGTGHSVMEVVNTMESVSSKAIPRRAADRRAGDVGSCVAVATRSQEELQWKTEKTLTDACASLCNFLAVSGLSS

SEQ ID NO: 22 - DNA, 1287 bp, Aspergillus oryzae
atggagagccctcgacagtctgacgcaagtactcccgtggagccttattctccaggatgcgtcgatacaccagcgacgcagtcatccgtcttgttcgatggaaatcttgaagagttgctgcgcaacttccccctggatcaatacatcctcgtcaccggcggtctcggtttcattggaagtcacacaacattggagctactcaaggccaattataacgtaatcgtcattgacaaccttagcaatgctttccagaacgtcttcgatcgcatcaaactcctggcttccaagcaccatgagcaacaaggaaccaaaatgcccgagatgcatctgcatgcccatgattaccgcgacagtgttgctcttcgcaagcttcttgagcaatatcaaatccagtcgaggtggggtacacctaagaccaagatctccggcgtcatccattttgctgcccacaaggcggttgaggagagtatcaggaatcctttgaagtactacgcaaacaatgtcggcggtctcatcgactttgccacgacgctgggtgagtttggtatcaagaccttcgtcttctcgtcatccgccaccgtatacggaactttggcaacctccggtcttcctcttaaggaggagctttgtgtccacaaggatgagatcttcgaagaccgtgacgggtccaagaagctcatggagcctgggtgcacaggtatcacaaacccctatggacgcacaaaatggatctgcgaagccatcttagccgacctcgcggcctccgatccagagtggaccatcgtggctctacgatacttcaacccagttggatgcgatgaatccggccttctcggtgaagatcccaagcaaatacctaccaaccttcttccagttgtcgtcaaggtcatgactgggcagtacaaggagctgcagatgtttggaaccgactgggacacggaagatggcacagctgtccgtgacttcatccacgtcaccgatctggctcgaggacatatcgcagccctcagtgctgccaatgaagggaagctcaaggagaatttccgcacattcaacctcggaaccggtacaggccattccgtaatggaggtggtgaacactatggagagtgtgtcttccaaagcaattccgagaagagctgctgaccgccgtgcgggtgatgtcggttcctgcgttgctgtggccaccaggtcacaggaggagctgcagtggaagaccgagaagacattgaccgatgcctgtgccagtttgtgcaatttcctggctgtcagcggactgtcctcttag

SEQ ID NO: 23 - protein, 304 aa, Aspergillus oryzae
MATMGPDKHVSGRRCLQSRRSRIILGAFVFIAILAVVIPPAVVVTLRKKNSMGPKANIFVPLYVYPAPGAWDPLEAEISSHPEANFTVVINPSSGPGPNALPDANYTREIPKLASYDNVRLLGYVPTTWAKRNISAVRRDIATYAEWPTNSSNPKLAVRGIFFDETPQQYDADALSYLQELTSFVKGLSGLGPDNFIVHNPGAVPDSRYMSSADSTVVFEAAYDTFNERDGTKQFDVLPKSDRGRGQLCIVIHSVPDGVEGSKLRDLVKKLRKTADEIFITHLSTDYYANFGDRWGEFVDWMAK

SEQ ID NO: 24 - DNA, 1742 bp, Aspergillus oryzae
aatccactttcttgccctcctttcgttgcattctaaggcattcacattttaattgcctacctcacatggcaacgatggggccagacaaacacgtgagcggtcgtcgttgcctgcaaagccgacgttctcgaatcattttgggggcctttgtctttattgctatcctcgcggtcgttatacctcccgcagtcgtcgtcaccctacgcaagaagaacagcatgggccctaaagctaacattttcgtccctctctatgtgtaccctgcccctggcgcctgggatccattggaagcagagtatgtctgattttttttttttatgtctatttgtatttctaattcttaccttcaatttcacccccactactccccctcaccccccaaagcccaatatgttctggtccctggggtatatacattatacaccataagcaagctgaaagccaattgcatgatgcatgcaagcgggaagctataattttgggggaaagtaactaagcgccacaggatctcttcacatccggaggccaactttaccgttgtgattaaccctagcagcggcccagggcccaatgccctgcccgatgctaattatacccgagagattcccaagctcgcctcttatgacaacgtgcgtctcttaggttatgtccctacaacctgggctaaacgcaacatctcggccgtgcgtcgcgacatcgcaacctacgcagaatggccgaccaacagttcgaaccctaagctcgcggttcggggtatattctttgatgagacgccccaacagtatgatgccgatgcgttgtcatatttgcaagagctcacctcattcgtgaaaggcctttctggtcttggtccagacaactttgtatgtgtgacccttctctttcacccctctgtaatttgtattaccgctcggtattcatggtaatttacatgggtacatacctcatgccccctgtattccttctccaccctctgtttacttttctttttatgctttttcacttttgcctctcggacagtcaatatggcccatacctgtctttttgatggcgctaggttctattacggtttccaactgcaactccgacaacctcattgggtcaagttggtcaacgatgatgctaatagtgactggctagattgtccataacccgggagccgttccagactctcgttacatgtcttcagctgactcgactgtcgtattcgaagcggcttatgacaccttcaacgagcgtgatggcacgaagcaattcgacgttcttccgaagagcgatcgcggtcgcggtcagctctgcattgtgatccactccgttccggatggggttgaaggttcgaagcttcgtgatctcgtcaagaagcttcgcaagaccgccgatgagattttcattacccacctgagcacggattactatgccaacttcggggataggtggggcgagtttgtcgattggatggctaaataattcctacgggcggcgcttttcgagcatacctgatgcaacattgcttatgatcagggcccgattggcgtcgactgataatatatgcgccggcgctttcttttgatggattggattgactaattaacttacgacctgtctatactgtatgaacgtctatatcctgtatgatgattctactgataatatgctatttgactttggccgttgggactatcaaatgatacctagaattacgatagagtttacgatcgtcaagatttcctttttgttttctc

SEQ ID NO: 25 - protein, 320 aa, Aspergillus oryzae
MAGIDEALPLKGKGQAASGWKTWSVKKRMLIIGAIALVIALAIGLGVGLGVGLNKGGGDDEGEVPPTTGGGVTTAKWQPAVGTKWQIELLYALNDTSVDADIYDIDLFNNDKSTITDLQKQGRKVICYFSAGSYENWRPDKDKFKDSDMGNTLDGWPNEKWLDLNSKNVRSIMTSRLDMAVEKNCDGVDPDNVDAYDNDNGLDMKKEDSANFMMWLANEAHARNMSIGLKNAGAIISAVIDNMQWSVNEQCAQYEECDTYAAFIDKNKPVFHIEYPKGDDTNNNDLVSTSQKKSACDFEGSSNFSTVIKNMNLDNWIQTC

SEQ ID NO: 26 - DNA, 1589 bp, Aspergillus oryzae
ccgcaggtgacctcgaaacaacagccactgtggcagagtccattatttggacattgactgccgcagtctgtaaggcattcacttgcctttaattccaacccaggacaggcgtctctgcatccgattccccggaccacctcaacgcaatctctgaacgagccacttcatagtttcagtgtaaccgcggagagagggatttctttgtcctctcctagcctatacatttaacggttgcctgtgaacccctgtggttctactccggaatacgccacttcatttgcttctttatctgatcgtttgatcttcctctcaggtcctctttatattttccctgcttaccccccaccttaccgctgtggtttgtgagaatcaaatcgcaggtcgtacctttctttctcggaattcccttctttgaacatttctttctttagtcgttcgttttacaggaatttttctttgtgaaatctattgcactatggcgggtattgatgaagcgctgcccttgaagggtaagggacaagccgcgtccggctggaagacttggtccgtcaagaagcgcatgctgattatcggcgctatcgctctcgtgatcgctctcgctattggtctaggagttggcttgggagtcggtctgaataagggtggaggggatgacgaaggcgaggttccgcccactaccggaggaggcgtgaccacagccaagtggcaaccggccgtaggaacgaaatggcagatcgagcttctgtacgcgctcaacgacacttcagtagacgcagatatctacgacattgatctcttcaacaatgacaagtcgaccatcaccgatctacaaaagcaaggacgcaaggtgatctgctacttctccgctgggagctacgagaactggaggcccgacaaggacaagttcaaggactccgatatgggtaacacgctggatgggtggccgaatgagaaatggcttgacctcaactccaagaacgtgcggagcattatgacgtcgcgtctggatatggcggtcgagaagaactgcgatggagttgacccggataacgtcgatgcctatgacaacgacaacggtctcgatatgaagaaggaggattcggcgaatttcatgatgtggctcgccaatgaagcgcatgcacgcaatatgtccattggtctgaagaatgccggggcgatcatctccgcagtgatcgacaacatgcagtggagcgtgaacgagcaatgcgcgcaatatgaggagtgcgatacctatgccgcattcatcgataagaacaagcccgtcttccacatcgagtaccccaagggcgacgacaccaacaacaacgatttggtcagcacgagccagaagaagagtgcttgcgacttcgagggatcctccaacttctcgacggtcatcaagaatatgaatctggataactggatccagacctgctagtcgcacaattgatccgcatctaaatactctgttcgatcagcaagggcgccgggagtttgagattggggttccaccatccccttaccatctatatagtttgactatgatgtaatctgcctcatttaattaacttggacattcgtctctttca

SEQ ID NO: 27 - protein, 794 aa, Aspergillus oryzae
MVLPWLLRTGCYFGLITCDTPPGVWPEGVPSVIAPVPPSRTSGVTTNSPGFTSSVLSFTSSSPPVTGSSSFVTTTTTLASSTSTSTSTSLPSFTSTLVSVSTPVSASSTMSLIPSPSSSIIPSATPSASVIANGNVAGNILVIAKDTAAANVATSGLNGYGIPFTTLLVPQSGVTLPELNGTSGGNFGGIVVASEVSYDYGAQGFQSALTTDQWNQLYAYQLEYSVRMVQYDVYPGPNYGASAVGGGCCDSGVEQLVSFSDVSDFKEAGLKTGAGVSTTGLWHYPASVNDTATTKEIARFAANGNYGSETTAAVINNFNGRQQMAFFLSFDTTWSATSNYLQHAWINWLTRGLYAGHRRVNLNTQIDDMFLETDIYYPNGTTFRITTADMDGISSWLPTINGKMNAGSSYFVEVGHNGNGVIEAAAGKDADACNGGGIEHDSPADTPLEFKKPLGTGTDLWPKDLTEYNWTTECTKLDDLFVWWTTPANRDKYGHISHTFTHEEQNNATYNDVKREISFNQAWLRQSGFYDAKYFTSNGIIPPAITGLHNGDALRAWYENGITNCVGDNTRTPLLNQQNSMWPYFTTSASDGFDGMQVNPRWATRIYYNCDTPACTVQEWIDTSAGSGDFSNLLATEKADTMRHLFGLHRDPYMFHQANLRNVGVDPVEINGETGQWSIMQAWVETMVQEFVRLVDWPIVTITHQEMSANFLDRYNRDQCNYSLQYTIGNKQITGVTLSAKDNTCNAPIPVSFPVAPTDTKGFTTEQYGSDPLTVWVQLSGSPVTFSLSTPIPL

SEQ ID NO: 28 - DNA, 2609 bp, Aspergillus oryzae
atggtcctaccgtggttgctgagaactggttgttacttcggacttataacttgcgacactcccccaggtgtttggcctgaaggtgtcccaagtgtgatcgctcctgtgcctccctcacgcacatctggagtcacgaccaactctcccggctttacttcgtcggtcctgtcgttcacttcttcttcccctcctgtcacggggtcatcgtctttcgttacgactactactactctcgcttcctccacttccacttctacttcaacctctctaccttcgtttactagcacactcgtttctgtcagcactcccgtgagtgcctccagcacaatgtctctaattccttctccttcgtcgagtatcattccttccgcaacaccttccgcttctgtcattgccaatggtaatgtcgcgggtaacatcttggtgattgcgaaggacaccgctgctgctaatgtggctacctcgggcctcaatggctatggtattccttttactaccttgctcgttccgcagtctggtgttactctgccagagctgaatggcacctccggaggaaactttggcggtatcgtggttgcgagcgaggtcagctacgactatggtgcccaaggcttccagagcgctctgactaccgaccaatggaatcaactctacgcctatcagctcgagtacagtgtacgcatggtgcagtacgacgtgtacccgggacccaactacggtgcctctgccgtgggtggcggatgctgtgactccggcgtggagcagcttgtttctttctcagacgtcagtgacttcaaggaagccggcctgaagactggtgccggtgtcagtacgacaggcctctggcactacccagcctcagttaatgatactgctaccaccaaggaaattgctcgtttcgccgccaacggcaactacggcagcgagaccactgctgcagtcatcaacaacttcaatggcagacagcaaatggctttcttcttgtcttttgacactacctggagtgcaacttccaactacttgcagcacgcatggatcaactggctcactcggggtctctacgctggccaccgtcgcgtcaacctgaacacccagattgatgatatgttcctcgaaactgatatctactaccccaatggaacgaccttccgtattaccaccgctgatatggatggtatctcgagctggctcccgaccatcaacggcaagatgaacgccggtagctcatactttgttgaggtcggacacaacggtaacggtgtcatcgaagccgctgccggcaaggatgccgatgcctgcaacggaggtggcattgaacacgactcgcccgctgatactcctctggagttcaagaagcctctgggcaccggtactgacctttggcccaaggacctgaccgagtacaactggactactgagtgcaccaagttggacgatcttttcgtctggtggaccaccccggctaaccgcgacaagtatggtcacatctctcacactttcactcatgaagagcagaacaatgccacctacaacgacgtgaagagggagatctctttcaaccaggcttggttgagacagagtggtttctatgatgccaagtatttcacatccaacggtatcatccctcccgccattactgggttgcacaacggcgatgccttgcgggcctggtacgaaaacggcatcaccaactgtgttggtgataacactcgcacaccgctcctcaaccagcagaacagtatgtggccttacttcactacctccgcatcggatggattcgatggtatgcaggtgaacccccgttgggccactcgcatctactacaactgcgatacccctgcctgcaccgttcaggaatggattgacacctccgccggcagcggtgacttcagcaacctgctcgcgaccgagaaggccgacaccatgcgccatctcttcggtcttcatcgcgacccttacatgttccaccaggccaatcttcgcaatgtcggcgttgacccggttgagatcaacggtgagactggccaatggtccatcatgcaggcgtgggtggaaaccatggtgcaggaattcgtgcgtctggtagactggcccatcgttaccatcacccaccaggaggtaagtcatggagatcttagaaactcctcctaacaccgcgcaattgctaattaatcaccccagatgtccgccaacttcctcgaccgctacaaccgtgatcagtgcaactactcgctgcagtacaccatcggcaacaagcagattactggggtgactctgagcgccaaggacaacacttgcaatgcgcccatccccgtcagcttccctgtcgcccccaccgacaccaagggcttcaccaccgaacagtacggcagtgacccactcaccgtctgggtgcagctgtcgggctcccccgtcactttctccctctcgacccctattcccttgtaaatggattgaacgatattgaattatggaagggctttgaaggattcctggaccataatatctaatgttattaatgggtttcgtgtagcgatttcgaataggggaagagatgaatgaaatgttaggtacatacatacataactacattgcatacatactacata

SEQ ID NO: 29 - protein, 2884 aa, Aspergillus oryzae
MAEILHVSALGWDKMKDHWWQFVFIAILIACVATGSLWLLYSGTKRLRNYIKTRPRSEKVPLNVSQRLVTLSNKLLSVPNIQRRKPSSFGVYLGSFSSPPDRDQLRLLNEWDLLIVDPFQSGTAQAIRYVEGKQLLGRVDLDRILSKDESTLSAIEKIENLLTGTFDSANFSGMVLANWEGKFPTPVFTKLVEVIDELGLAVYLETAPPDFLKDHNSMQNPAISGIVIQNASILPEGQKRDYFQLVKMQPTIKAFVSEACVRDFVVMAWETIDDNAALSNAVVQRSLQWCNFYSAIPWIGQKSALTNAALNVKISEPLSSFGWLKDAEIIKAHDRWRSNLHLKDVASDTNAWNTLLPFFPTLEELLTSSEYGQPESNELTTKLRDPPEWVAQVKSLGSPLSISMAGIEYNSLGCFPLGSEATALAFAEVLQSQLRLKSLGLLHPVPASKIQSIGLLLKKFHESYLLPNATSSDPYVIPNATSDQLATTIKELSNLATNGSLQVNLGLDSGLRKSVDVRFWAVYQMDSDGFEVFASKKAQGLAGTVLHTFLSAKGYPRHVCFEVETALAKWSQDLVKDTGLPRRLVEDIDMLSPEERLLLFQHLSLTDSYSELSDTICAYIRRLLIDAPSLAQLKELNTVSYLEGSASPEILVNTRIKWYREQGCQHPSPSKCLALFYQTDAAFTQILREHREGDLALISKGFCQLLQNDHIDTYTDIMALALFCAARKGAIDEIYTEVTDRNPLFNNQSDQAAAFSESFALGSRCEVYFDVQPSAFGKLLSDRFRREYNDEKLPDWINGAPEMATSYAGAQIDVNPDHKVKSMPGYQRFTFLGVFAFPALIDIILLTIIGRGLYLSAFMTHDELQSATIALMISLLLSGAIGTMIACGGPYYLISMAFAASNMFVLIRLIAGVAFTIAAGLIGFIVISGVKSPQAGIIFYLYLVALTIYLTTFATLASFSYPGTGFLSGRKVIFSCIPILFVSPIITTWSGHDSAIYLAVLYVFIGFLLLGLRSVASKWVTWYQNIRRTDDTEIRKWYIATYGNNDEKVFGNMSDPAVLKMSRDALYKDVLAEKSRSFFSKPTTDTLVRELARDWDSTNFLLDWYCRYADVPRPIPFSSSWNIQTKVGLDVLRNSQKGIRLHNAFIHWRQSSKEIGCGILYFIIALLDKWVELLSGGQLVGLSTSLSDANRMAVGFGLAYYLIGAVLIDTKAQELHDLVGQHSAVAVGSAKEIRPSQKRDVRFKRKVYWKTFFKFLMWLVWSLAIATALIWTFQAPVQAMIMFFAYVLSYTGLLWYQYTKIFTGPHALIPLMTGVVVGLPVGIALKVCLGNNFLYSQVIGLGAATWTVAILSLFTAKMGMPKKVDSPVELGKTFHAYTAPWADPEWSQQELQTFFEGVSVVPADARLKLVPGSHPGVEVKTILLSRKIEPRIEEAFPESEKLISMALGAWETGEISLELVPLGSLGPNIQALSCSMSGHLQIAICVGRGLDERIDVSANCQVIAETLLHAVAESMMRMPHEYAVLSESLVTAGVTETTARQLREEPDTPLVVRWSKKELLRQLCLGFEVDSHWEKLPENVRNMLLDRCLGRPCLLSEGSQQWLQTSLCRFDTSDLNVHVARCNLGAATAVSILDYANYGTGEAGAIKDPEIPIYIPEIPKKLPMAMSIIQKPLSYVYHSIGSGVKFFIAALLADSEFQREFDHVMSERHTLIRVPLVFLLNMVWLYFKTVQDIGLSFFLFHGRSNVKRLWNETKGITVSIKKSRFVVQSLEGTFAAFRHNEPDGGFKVYYYSGEHKTEPEGMKLLKYVSTYSKDMLLLIRQEFKDGKVLNEYHYDYRAPTKKSFTLSKAWATRIPLGRRCVRGQNNLQSVQYNRKGLIEAGSYMKDGNLIRFKYHYRKNPRFGDELLRAEFSLTHITCTVSWCAPPLRHPEKVERWIPHSKVTEATFVQGADVYEARWLYDHKFHPTIFTTLNGQKVQTPPMIENDFIGVLAKPKQTSFANDNPLLYCDSLSSNTVTRFLGLTTKRFPVSTSRARSLLWKSWKDRVDFDAIMVRWMDERLLRREKTLAPYWRARNRGDLAAAKKYLELRADAITASADLDDNISSWTPLAVKISDLFNFGPGGDAVVHTRSKDFGSDTDKSMHVMAADNGTWPNEGGGVSACRRDMINSLRTVKWHMICESANDFGIPKHQTEQNVLSLKVVPLWGLDFLTPTHGLFRNKLDSEVDNVTSASDMDIKLNFIPILTALVKGARATHLSKADIHQATRALVNLNTYFQDSRHWTQIWNSDIVKESWRDLWLTQEMPNTVPSSQWFRTELPTLTSLDTALELWYRYLFIFSIPIPEKIPSVFQASHHSVSASYGVVCKMKRNCTLQIWDHAISWRETNLCLSSALCKLSPFVRNALLGLMRITSALTLHHADIILPCADFFNPGWEVEIGTCQGTIEHRNVFRRKVDPVVNGITDMQKFAPVKEIKSERPTVTMLSHVWYAKDIKIALLAADIIINQWKFDDYHLDIYGAIDKAPTYSTECQEIIASKGLRGKVTLRGTADPMKVLENTWLFLNSSLSEGLPLALGEAALTGAPVVCTDVGASLRVLSDPDDFSRYSAVVAPNDAHALAKAQITMLGLLGEWSKYTDDTEPAPVLTSSPTPEDVAKITRRMYEKSDYRRKLGMMTRDIVQKSFSGDRYLREHEQMLWIGKSAKIMANRVGGAITEPTDIATAMRQTLPIEEEVITIPRSAVHSWRSSAASGMSTVYSEVSNFPMLNGYHRPSSIRSGISGMSTDTESFLPLPSNASLPVFAPRQTLGYPSTPDGRLSPSGRLSPLPNPRNSGRRSMSTAGREQLRGLGREELNPYRNSDVSTIMRDEFLKSSIYKNIEGSNSTPNMI

SEQ ID NO: 30 - DNA, 9050 bp, Aspergillus oryzae
cggacctgtgaggttggcctgcaatatctaatcaggatggcggaaatcctccacgtctcagccctcggctgggataaaatgaaagatcattggtggcagtttgtaagtagtgattgcatatacgtttcagatatcactgactaatgctatgctaggtgttcatcgctatcttaatagcgtgtgtagctacaggatccttgtggcttctgtactctgggacgaagagactgcgcaactacattaaggtagggcttctttgatatgcttgtgaatgtatatctgatctgtcactcacctgattcaaatcatagacaaggccacgttcagagaaagtgccgctcaatgtatctcaacggttggttactctttccaacaagttgctcagtgtgccaaacattcaaagacgcaagccgtcttcttttggcgtctatctgggttcattcagttccccgccagatcgggatcagcttcggcttctgaatgaatgggacctgttgatagttgacccttttcagtcgggcacggcccaagcaatccgttatgtggagggtaagcagttattgggaagagttgaccttgatcgtatcctctcaaaggacgagtccacattgtcagcaattgaaaagattgaaaaccttctcaccggcacattcgatagtgctaacttcagcggcatggtactggccaactgggaaggaaagtttcccaccccggttttcactaagcttgtcgaggtgatcgatgagttgggtttggcagtgtacctggagacggcacccccggactttctaaaggaccacaactccatgcagaaccctgcaatttccggaatcgttattcaaaatgccagtatactgccagaaggccagaagcgcgactattttcaactcgtgaagatgcaacccaccatcaaggcgttcgtctccgaagcttgtgtgagggatttcgtggtgatggcgtgggagacaatcgatgacaatgccgcgttatcaaatgctgttgtccaaagatctcttcagtggtgtaacttttatagtgcgatcccgtggataggccagaagtcggctctcacaaatgctgcccttaatgtcaagatctcagagcctctctcctcttttggatggctgaaagatgccgaaatcatcaaagctcacgatcgctggcgctcaaatttacatctcaaggatgttgcatccgacacgaacgcttggaatacattgttgccgtttttccccaccctggaagaattgcttacctcgtcggaatatggtcagcctgagagcaacgagttgacgacaaaactccgtgatccaccggagtgggtagcacaggtaaaatctctagggagtccactttccatatcaatggccggcattgaatataactctcttggttgcttcccgcttggatctgaggcgacagcacttgcctttgctgaagtccttcagtctcaattgcgccttaaatcactgggcttgctccacccggttcctgcttccaagattcagagcatcggtctgctcctcaagaaatttcacgaatcttatttgcttcccaacgcaaccagctcagatccttacgttattccaaacgcaacctcggaccaactggcgactacgatcaaggaactgtcgaatctggcaactaacggctcattgcaggtcaaccttggattggactcaggacttcgtaagagcgtcgacgtgcgcttttgggcagtttatcagatggactcagatggatttgaagtttttgcttcgaaaaaggcccaaggtttagcaggaactgtactgcatacattcttgtctgcaaaaggttacccccgccacgtttgttttgaggtagaaaccgctttagccaaatggtcccaggacctcgtcaaggatacagggcttcctcgccgactcgtcgaagacatcgacatgctgagcccagaagagcgactgcttctatttcagcatctctccttgaccgactcatacagtgagctctccgatactatctgtgcttacattcggagactgcttatcgatgcaccttcactcgctcagctgaaggagcttaacacggtctcatatcttgaaggctcggcttctcccgaaattttggttaatacccgcatcaaatggtaccgagaacagggatgccaacatccgtcaccatccaaatgtctcgcattattctaccagacggatgctgcttttactcagatcctaagggagcatcgcgagggagaccttgctttgatatcaaagggcttctgccagctgcttcaaaatgatcacatcgatacgtatactgatatcatggcattggcacttttctgcgctgcgaggaaaggagcaatcgatgagatttatactgaagtgaccgatcgtaacccgttgttcaacaatcagtcagaccaagcggctgctttctcagaatcgtttgctttagggtcacgttgtgaggtctactttgatgttcagcctagcgcttttggaaagctgctctcggatcgtttcagaagggagtacaacgatgaaaagctccccgattggatcaatggcgcgcctgagatggccacatcttatgcgggtgcccaaattgacgttaacccggatcacaaggttaaatcgatgcctggttaccagcgatttactttcctcggtgttttcgcattcccggcattgatcgacatcattctgctcacaattatcggccgtggtctctacctttcagccttcatgacccatgacgagctgcaaagtgccaccatcgctttgatgatctctcttctcctatctggtgcaatcggtacgatgattgcctgtggaggaccctactatctcatttcgatggctttcgcagcttcaaacatgtttgtccttatccgactaattgctggtgttgcgtttacaattgctgctggtttaatcggattcatcgttatctctggcgtgaaaagcccacaggctggaattatcttctatctgtacctagtcgccttgaccatttacctgacgaccttcgctaccctcgctagctttagttaccctggaaccggtttcttgtccggacgcaaagtgatcttcagctgcatccccattcttttcgtctcacctatcatcactacttggagcggccacgattcagctatttacctcgctgtgctatacgtgttcatcgggtttttgcttctcggcttgcgatcagttgcctccaaatgggtgacctggtatcaaaacattagaaggacggacgatacggaaattcggaaatggtacattgccacgtacggtaataatgacgagaaggtttttggaaacatgagtgacccggctgtcttgaaaatgtcaagagatgctctctataaggatgtcttggctgagaagtcccggagcttcttctctaagcccacaactgatacgctggtccgcgagcttgccagggactgggattcgacaaatttcctcctcgactggtactgtcgttatgctgatgtgcctcggccgattccgttcagttcttcttggaatatccagaccaaggtcggactagacgttcttcggaattcccagaaaggaatccggttgcataatgccttcatccattggcgccaatcgagcaaagaaataggctgtggaatcctgtactttatcatagccctcttggacaaatgggttgagttattgagtggtggacaactcgttggtctctcaacctccctttctgatgccaatcgaatggcagtcggatttggactggcttactacctcattggggccgttctcatcgataccaaagcccaggaactccatgatcttgtgggccagcattcggctgttgctgtgggatcggccaaggagatacgtccgtcccaaaagcgagacgtgagattcaagagaaaagtctactggaagacctttttcaaattcctcatgtggcttgtgtggagcttggctattgcaacggctttgatctggactttccaagcaccagtgcaagcgatgatcatgtttttcgcttatgtattgtcctataccggcctgctttggtaccaatatacaaagatcttcaccggcccgcacgccctcataccgctgatgactggtgttgtcgtcggattgcctgtcggtatcgccctcaaagtatgccttggcaataacttcttgtactcccaggtgattggtctaggagcagctacatggacagtggctatcctctcccttttcaccgccaagatgggcatgcccaagaaagttgactcacctgtggagcttgggaagacattccacgcatataccgctccatgggcggatcctgagtggtcacaacaagagttacagacattctttgaaggagtctcagtcgtccctgccgatgcacggttgaaacttgtgcccggctcgcatcctggtgttgaagttaaaactattctactttcgcggaagatagaaccaagaatcgaagaggccttcccggagtcggaaaagctcatcagtatggccctgggtgcctgggaaacgggcgaaatatcccttgaacttgtgccattgggctcgcttggccccaacatccaggcgttgagctgcagtatgtctggtcatctgcagatagccatctgcgttggacgaggactagatgagcggattgatgtcagcgctaactgccaggtcattgccgagactctactccacgcggtcgccgaatcaatgatgcgaatgccccacgagtatgccgtgctttctgaatcgcttgttactgctggtgtgactgaaacgaccgcccgacaacttcgggaggaacctgacactccactcgtcgtacgctggtcaaagaaggagcttctgcggcaactgtgtcttggatttgaggtcgactctcattgggaaaaactgcctgagaatgttaggaacatgttgttggatcgttgtcttggtaggccatgtctactatccgagggcagtcaacaatggcttcaaacgagtctttgtcggtttgacacaagcgacttgaatgtgcacgttgctcgctgcaacctgggagctgccactgctgttagtatccttgattacgcgaattacggaaccggtgaagcaggggccatcaaggatccggaaatcccgatatatatcccagaaatcccgaagaagcttcctatggccatgtccatcatccagaagccgttgagctatgtatatcactctattggctctggagtcaagttcttcatcgctgctttacttgccgattccgaattccagagggaatttgatcatgtcatgagtgagcgccacacattaattcgggtaccgcttgtgtttttgttgaacatggtttggttgtatttcaaaacggtgcaagatattggtttgtcgtttttcttattccatggccggtccaacgtgaagcggctgtggaacgaaaccaagggcattaccgtcagcatcaaaaagagtcgctttgttgtgcagagcttggaaggtaccttcgctgcttttaggcataacgagcccgatggcggcttcaaggtatattattactcgggagagcacaagacagagccagagggcatgaagcttctcaaatatgtcagcacatattcaaaggatatgcttctgctcattcgccaagagttcaaggacggcaaggtgctcaacgagtaccactatgattaccgcgctccaacaaagaagagctttaccctatccaaggcgtgggcgaccagaatccccttgggtcggcgttgcgtacgcggacaaaacaacttgcaaagtgttcagtacaaccgcaaaggtctcatcgaagcgggctcctacatgaaggatggaaatcttattcgcttcaaatatcattaccgcaagaaccctcgcttcggtgatgagctgttgcgcgctgagttttcgttgacacatatcacttgcacagtttcctggtgcgcgcctcctcttcgccatccggaaaaggttgagcgatggatccctcattctaaggtcaccgaagcgacgtttgtccaaggagctgatgtctacgaggctcgttggctgtacgatcacaagttccatcccacgattttcacgacgcttaatggacagaaggtgcagacacctccgatgatcgaaaacgacttcataggagtgctcgccaaacctaaacaaaccagctttgcgaacgataaccctcttttatactgtgacagcctcagctcgaacactgtcacccgtttcctggggttgacaactaagcgcttccctgtatccacttctcgtgctcgttcattgctatggaagtcttggaaagaccgcgtagattttgatgcaattatggtccgttggatggacgagcggctcctgcgaagagaaaagaccctggctccctactggcgtgctcgtaatcgtggtgatctggcagcggcgaagaaatatcttgaactccgcgcggacgccatcaccgccagcgctgatttggatgacaacatctccagctggacccctcttgcggtgaagattagcgatcttttcaacttcggacccggaggcgatgcggtggtccacaccagatcgaaggacttcggctctgatactgacaagtcgatgcatgtcatggctgctgataatggcacttggccgaacgaaggaggtggtgtctctgcctgtcgacgtgatatgattaattcgctaaggacagtcaagtggcacatgatttgcgaatcagcaaatgactttggtattcccaagcaccagacggagcaaaatgtcctttcgttgaaagtggttcctctttggggcttggacttcctcactccaacacatgggcttttcaggaacaaactcgactcggaagttgataatgttacatccgccagtgacatggatatcaagcttaacttcatcccaattctgactgctctggtgaagggagcgcgtgcgactcacctttcaaaggctgatatccaccaggcgactcgggctttggtcaacttgaacacatacttccaggactcgcggcattggactcagatctggaacagcgacattgtcaaagaaagctggagagacctttggcttactcaagagatgcctaataccgttccatcatcccagtggttccgcaccgaacttccaaccctaacatcacttgatactgccttggaactttggtatcgatatctcttcattttctccattccaattcctgagaagatacccagcgtctttcaagcatcgcatcacagtgttagtgcgtcctacggggttgtatgcaagatgaagagaaactgcaccttgcagatttgggaccacgccattagttggcgtgaaacgaacctctgcctgtcgtccgccctgtgcaagctttctccattcgttcgcaatgctctcttaggtttaatgcgcatcacttcagctcttactttgcaccatgccgatatcattcttccttgcgctgatttcttcaatccaggctgggaggttgaaattggtacctgtcaaggaaccattgaacatcgcaatgttttccgcaggaaggtcgaccccgttgtcaatggtatcactgacatgcaaaagttcgcccctgtgaaggagatcaagtctgagcgcccgacagtcaccatgttgtcgcacgtgtggtatgccaaggatatcaagatagctctgcttgccgccgacatcattatcaaccagtggaagtttgatgattatcacctggatatttatggggccatcgacaaggcgccaacatactctactgaatgtcaagaaatcatcgcctccaagggtctccgaggcaaggttactctccgtggtaccgcagatccgatgaaggtgctcgagaacacctggcttttcctcaattcgtcactttccgaaggtctgcccttagctttaggtgaagctgctctgaccggtgcccccgtggtttgtactgatgtcggtgcatctcttcgtgttctgagcgacccagacgacttctctcgttacagtgccgtcgtcgcacccaatgacgctcacgccctcgcaaaagcgcagatcaccatgcttggccttctgggagaatggagcaagtatactgatgacactgagccggcacctgtgctcacttcatctccaacaccagaggatgttgccaagatcacccgccgcatgtacgagaagagcgattatcgtcgcaaactcggcatgatgacccgcgatatcgtccagaaatcattcagcggcgaccgatacctccgtgagcacgagcaaatgctgtggatcggcaagtctgctaagattatggccaaccgagttggaggagccatcaccgagcccacagacattgcaacagccatgcgccagactctcccgattgaagaagaagtcatcaccatccctcgcagcgccgtgcactcgtggcgttcgtctgctgcatcgggcatgtcgacagtatacagtgaggtttccaatttcccaatgctcaatggctaccaccgcccatcctctattcgctcaggtataagcggtatgtcaacggatacagagtctttccttcctctccccagcaacgcctctctccctgtcttcgctcctcgtcagaccctgggctaccccagcacccctgacggtcgtctctcaccttcggggcgtctctcaccgctaccaaacccaaggaacagtggtcgacgatccatgtcaaccgctggccgcgagcagctacgtggtctcggacgcgaagaattgaacccttaccgcaattccgacgtcagtaccatcatgagagacgaatttcttaaatcaagcatctacaagaacatagaaggcagcaacagcacccccaacatgatctaaaacgaaaaaggaaaagaaacagaaaaatcccatctagttctcttgtttttacacttttttttttttctttttttttttgcatactatgattgattcttgggttatactcccggccctggcaataattgctaatctgtcattgtctataccaaccatataccccgagatgatgaagtgctcgttgtaaatacctgcatcttgcatatactttcctttattttgcatctaacttcatcatta

SEQ ID NO: 31 - protein, 428 aa, Aspergillus nidulans
MDSPRRSDASSPAEPCSPVCVDTPATQSSVLFDGNLDDLLRNFPLRQYILVTGGLGFIGSHTTLELLKASYNVVVIDNLSNSFQSVFDRIKHLAQKHHDERGTEMPALHLAAHDYRDTAALRQLLDQYQVDSRWGTPKSKISGVIHFAAYKAVEESIKNPLKYYANNVSGLIDFASTLGKYGIKTFIFSSSATVYGTLATSGLPLKEELCAHKDEIYHDADGVAQTIRAGSTGITNPYGRTKWMCEAILADLAASDPEWTIVALRYFNPIGCDESGLLGEDPKQTPTNLLPVVVKVMTGEYNELSMFGTDWETEDGTAVRDFIHVTDLARGHIAALDAANERKLAENFRAFNLGTGRGHSVKEVVDAMESVSRKQIPVRAAPRRPGDVGSCVAVATRSQQELRWKTEKSLTDACGSLCKFLEVSGVTL

SEQ ID NO: 32 - DNA, 1287 bp, Aspergillus nidulans
atggatagtcctcgacgatcagatgcaagctctcctgcggagccctgctctccggtatgcgtggacacaccagcgacacagtcctctgtcctgttcgacggcaatctggatgacttgttgcggaacttccctcttcgtcagtacatcctggtcactggcgggctcgggtttatcggaagtcacacaacattagagctgctgaaggccagctataacgtggttgtgatcgacaatctcagcaattctttccaaagtgtcttcgaccgcatcaagcacttggcgcagaagcaccatgacgagcgaggaactgaaatgccagctctgcatctggctgctcacgactaccgagacactgccgctctcaggcagcttctcgaccagtatcaggtcgattctagatggggcactcccaagtccaaaatttccggcgtgatccactttgctgcgtataaagcagtcgaggagagcataaaaaatccgttgaagtactatgcaaacaacgttagtggtctcattgactttgcctcgacactcggaaagtacggcatcaaaacattcatattttcctcatcggcaaccgtttatggcactttagccacttctggtcttccactcaaggaagagctctgcgcccacaaggatgaaatttaccacgacgcagatggagtcgctcaaaccatcagagcagggtctacgggaattaccaatccctatgggcgcaccaagtggatgtgcgaagccatactggcggatcttgcagcttctgatccggagtggacgattgttgcgctccggtatttcaacccaatcggctgcgacgagtcgggattgctcggtgaggatccgaaacagacccctacgaatcttttgccggtggtcgtaaaggtcatgaccggagagtacaatgaactctcaatgttcggcactgactgggagacggaagatggcaccgccgtacgtgacttcatccacgtaaccgacttagcccgagggcatatagctgctcttgacgctgccaacgaaagaaagttagctgagaacttccgcgccttcaacttgggaactgggcgcggacactcagtcaaggaggtagtggacgctatggaaagcgtgtcgcgcaaacaaatccctgttagagcagcccctcgtcgccctggggatgttggatcctgcgttgccgttgctaccagatcgcagcaggagctccgatggaagactgaaaaatcacttacggacgcatgtggaagtctgtgcaagttcttggaagttagcggtgttactttatga

SEQ ID NO: 33 - protein, 278 aa, Aspergillus nidulans
MAVLIFVAILAIVLPTSIIVTRRKNNNMGPKAKVFVPLYVYPAPGAWDPLVNVITAHPDVNFTVVVNPGSGPGPNPLPDRNYTQEIPRLTAHDNVRVLGYVATTYAKRNISSVRNDIETYAAWPTISANPKLAVRGIFFDETPQQYNASDLAYLEELTSVVKNTPGLGPDHFVFHNPGVVPDPRYLSTADSTVVFEATYDTFQDRDGARLFETIPNSNRSQLCAVVHSVPDSVEGSELRKFVKQARRVADEIFVTHLSTNYYASFGDKWDDFVRLMAQ

SEQ ID NO: 34 - DNA, 1282 bp, Aspergillus nidulans
atggccgtcctcatatttgtcgctattcttgcaatcgttctcccgacatcaattatagtaacccgacgcaagaataataatatgggcccgaaagcaaaggtctttgtccctctctatgtgtaccctgctcccggtgcgtgggatcccctagtgaatgtgtaagtttcctttgacctgggtgcgtttttattttgcccctcgcgtttttgcgaacgaacccgaacccctgtaggtcagacaggttgacctagattctggaatcatgcgaacgccatcagccgcctgcagaggcaccggcgtgggacagaaggcgcctttgttttttcgggggctgcagctaaacgccgctgtaggatcacggcacaccccgatgtcaacttcacggtcgtggtaaaccctggcagcgggccgggtccgaatcccctgcctgatagaaattatacgcaggaaattcctcggttgacggcgcatgacaatgtgcgcgttctcggctatgtcgccactacatacgcgaagcgcaacatttcgtcggtgcgcaatgacattgagacctacgccgcctggcctacaatcagcgctaaccccaagcttgccgttcggggaatattcttcgacgaaacaccgcagcagtacaatgccagcgatctggcgtacctagaggagctcacctccgtggtgaaaaacacccctgggctcgggcccgaccatttcgtaagtttgacgctgtttgtgatgagcaccacgcggatctgcctaattccgagtgagcctcttgttggggcgatatctcatatccatctccaacatctacaatctattttcccttggcagtgtggttggatgtcttagtctgtgacttgttctagccttggaatcggaccgatctctgtcattcaactaccggtgccgcggtgtggccggtagattgggtactagccatgctaactggcgaatgcaataggttttccacaaccctggagttgtcccagaccctcgctacctgtcgacggctgactcgactgtggtgtttgaggcaacgtatgacaccttccaggatcgcgatggggccaggctgttcgagacaattcccaacagcaaccgtagccagctctgcgcggtggtccactcggtgccggacagcgtggaagggtcagagctgcgaaaatttgtcaagcaggcgcggcgagtcgccgacgagatttttgttacccatctcagcacgaattactacgccagcttcggagacaagtgggacgactttgttcgtctgatggctcaatag

SEQ ID NO: 35 - protein, 375 aa, Aspergillus nidulans
METLKAPSTGWKSWTAKKKALLISSILIFIIALAVGLGVGLGLGLNKGSDNDNESGGNNTTPTTPNNTAIWQPAVGTSWQIVLRYALNDTSYDVDVYDIDLFDNKKAIIDELHSDGRKVICYFSAGTYEDWRDDADKFPEDDIGDNLDEWEGESWVDIRSSKIRDIMLDRLDIAVQKGCDGVDPDNVDGYDNQNGLDLTQDDTVDYMNFLADEAHSRNLSIGLKNAGAVIPRVISRMQWSVNEQCAQYDECDTYAAFVRRGKPVFHIEYPKGDDTNNEVQVTGQKKATACDFDDSNEFSTLIKNMDLDNWLQESGAYLPIQVPPQTPQVRTQCHGQTTLIRAPTTGPTLHSQSSSPLLSRERQIRRPRYLLPQPT

SEQ ID NO: 36 - DNA, 1321 bp, Aspergillus nidulans
atggaaaccctcaaggctcccagcacgggctggaaatcctggacggccaagaagaaagctctcctaatctcgtcgattctcatcttcataatcgccctcgctgttggtctcggcgtcggtcttggcctcggcctcaacaaggggagcgataatgacaatgagagcggcggtaacaacaccaccccgaccacccccaacaacaccgccatttggcagcctgccgtcggcacctcctggcagatcgtgctgcgctatgccctgaatgatacctcatatgacgttgatgtatacgacatcgacctcttcgataacaagaaggcgatcatcgacgagctccactccgacggccgcaaggtgatctgctatttctcagcaggcacgtacgaggactggcgcgacgatgcagacaagttccccgaagacgatatcggcgataaccttgatgaatgggaaggcgagagctgggttgacatccgctcgtccaaaatccgcgacatcatgctcgaccggctcgatatcgccgtgcaaaaaggctgcgacggagtcgatccagacaacgttgacgggtacgacaaccagaacgggcttgacctcactcaggatgatacggttgactatatgaatttcctggcggatgaggcgcactcacgcaatttgtcgatcggactcaagaacgcgggcgccgtgatcccgcgcgtgattagcaggatgcagtggagcgtcaacgagcagtgcgcgcagtatgacgagtgcgatacatatgcggcatttgtccggcgcggtaagccggtctttcatattgagtatccgaagggggatgacacgaataatgaggtccaggttacggggcagaagaaggcgacggcctgtgactttgacgactcgaatgagttctcaaccttgatcaagaacatggacttggataactggctgcaggaatgttagctcttactgtctactctaaggttatgttgagaacgagcaggggttctgttgatcttgtatctagatactagtgtaatattcatacccgatattgtacttcattactttgtaaccgggctcggccatcatcagaaacccttcaatcgccaacgtcttactggaaactcagttcctaccgtatactatagccggagcctaccttcccattcaagttccaccacagaccccgcaagttcgcacgcaatgtcacggtcagaccacactcattagggccccaacgacaggccctacccttcattctcagtcttcgtcaccccttttgtcaagagaacgacaaatacgcagacctcgctatctcctgccccagccgacgtag

SEQ ID NO: 37 - protein, 912 aa, Aspergillus nidulans
MVAPTLVLQIGCFFGIFTCDTPRGVWPEGRPTVLSPWPPSPSSTSSTTSVPPAASSASTISVPTVTGPTEPTVTVTATSSASTTLTTLTTLPSPTDSATATSASTSADSTTISSTSSASDPAGSSTLVPTSEPSASEPSTSEPSSSTGTPGTSTSDPDPTSATEPSSTSTSTPEPSGTVTSSTSTSSPSTSPPSTSSTSSTSPSSTLTSTSSPSTSSTLTPSASPTPSTTVTPSPSMSVTSTSVAPSATGSLANNILVIARDSTQASVASSGLNGYGIPFTTLLVPQAGVELPALNSSSGGNFGGIVVAGEVSYDYGNDNWRSALTDDQWNQLYAYQLAYGVRMVQYDVFPGPNFGASSIGNGGCCADGVEQLVYFTDTSDFPTAGLKTGSSAGVSTSGLWHYTASVTDTNTTKAIASFASGGGVDGESVAAVINNFDGRQQMAFFIGFDTVWSQTSNYLQHAWITWITRGLHAGYRRVNLNTQIDDMFLETDIYQPSGTIFRITTDDMDGITNWLPSIRAKLNAGSTYFVEIGHNGNGNIEAGTTAAGESTCSGGAIEYDSPPDTALEFVKPIGTGTDVWPTSPTNFTWTTTCMNADSLLIWFQNHLDDYAYISHTFTHLEQNNATYSDIYKEISFNQVWLERAGFSAASKFTSNGIIPPAITGLHNGDALRAWWDNGITNCVGDNTRPVLLNSENEMWPYFTTEAADGFAGMQVNPRFATRIYYNCDTPACTTQEWIDTSAGAGDFNDLLDTERAEVLRHLFGLHRDPYMFHQANLRNVGIDPITVGSETGQFSIFQAWVETIVAEFTRLVDWPIVTITHQEMSAEFLARYTRDHCDYGLNYILDNGAITGVTVTANGNTCDANIPVTFPTAPTDTLGFATEQLGSDPFTVWAQLSGSPVTFSLATPIAL

SEQ ID NO: 38 - DNA, 2842 bp, Aspergillus nidulans
atggtcgctcccacgctggtgctgcagatcggctgtttctttgggatatttacctgcgacacgccccggggagtctggcctgaaggacgcccgactgttctttccccgtggcctcccagtcccagctcgacgagctcaactacttcggtgcccccggctgcttcgtctgcatctacgatcagtgtcccgacagtcaccggcccgactgagcctacagtgacggtgactgcaacgtcctctgcatctactactctgacgacgctcacgactctgccctcgcccacagactctgctactgccacttctgcttctacttctgctgattccactactatctccagcacatccagtgcttctgacccggctggctcttccactctcgttcccacctcagagcctagcgcctctgagcctagcacttcagagcccagttcatctaccggtactccagggacttcgaccagtgatcctgatcccacgagtgccactgagccgtccagtacttcgacctcgactcccgagccttcaggtactgtgacttcaagtacttcgacttcgagtcctagtactagcccccccagcacttccagcacttccagcactagcccgtctagtaccttgacctctacctcatccccctctacgtcttctaccttaacgcccagtgccagccctaccccgtctactacagtcaccccgtcccccagcatgtctgttacttccactagcgtggcaccctcggccaccgggtccctggccaacaacatccttgtcatcgcccgcgactctacgcaggccagcgttgcctcgtccggcctgaatggctacggaatccccttcacgacgctcctggtccctcaggccggcgtcgagctgccggccctgaactcctcctcagggggcaactttggcggtatcgtcgttgccggcgaagtcagctacgactacggtaacgataactggcgctccgccctgacggacgaccagtggaaccagctgtacgcgtaccagctcgcctacggcgtgcgcatggtccagtacgacgtcttccccggtcccaacttcggcgcctcgtccatcggcaacggcggctgctgcgccgacggtgtcgagcagctcgtctacttcacggataccagcgacttccccacggccggcctcaagaccggctccagcgcgggcgtctcgacctcgggtctctggcactacacggcttccgtcaccgacaccaacaccaccaaggcgattgcgtcgtttgcctccggcggcggggttgacggcgagtctgtggccgcggtcatcaacaacttcgatggccgccagcagatggccttcttcatcggcttcgacactgtctggtcccagacctccaactacctgcagcacgcctggatcacctggatcacgcgcggcctgcacgccgggtaccgccgcgtgaacctgaacacccagattgacgacatgttccttgagaccgatatctaccagcccagcggaaccatcttccgcatcacgaccgatgatatggacggcatcaccaactggctgcccagcatccgcgccaaactcaacgctggaagcacctactttgtcgagatcggccacaacggcaacggcaacatcgaagccggcaccacggcggccggtgagagcacctgctccggcggcgccatcgagtacgactcgcctccggacacggccctcgaatttgtcaagcctatcggcaccggcactgacgtctggccaacctcgccgaccaacttcacctggacaacgacctgcatgaacgcggacagcctgctcatatggttccagaaccacctggacgactacgcctacatcagccacaccttcacccacttggagcagaacaacgccacctacagcgacatctacaaggagatctccttcaaccaggtctggctcgagcgtgctggcttctcggccgcgtccaagttcacctccaacggtatcatcccgcccgccatcaccggcctgcacaacggtgacgctctccgcgcctggtgggacaatggcatcaccaactgcgtcggcgataacacgcgtcctgtcctcctcaacagcgagaacgagatgtggccctacttcaccactgaggccgccgacgggttcgcgggtatgcaggtcaacccgcgcttcgcgactcgaatctactacaactgcgacacccctgcctgcacgacacaggaatggatcgatacctctgccggcgccggagacttcaatgacctgctggacacagagcgcgccgaggtcctgcgtcacttgttcggcctccatcgcgacccgtacatgttccaccaggccaacctgcgcaatgtcgggatcgaccccatcaccgtcggctctgagaccggccagttctccatcttccaggcgtgggttgagaccatcgttgccgagttcacccggctggtggactggcccattgttacgattacgcatcaagaggtacacttccctctgctttccctctgcttcccctgcttttctaccctctgctttaattcttgcgcttgctttcctcatagttacagcttgctaactaaagtagatgtccgccgaattcctcgcccgctacacccgcgaccactgcgactacgggctcaactacatcctcgacaacggcgctatcaccggcgtcaccgtgactgcgaacggcaacacctgcgacgcgaacatccccgttaccttcccgaccgcgcctacggacaccctaggcttcgcgacggagcagctgggcagcgaccccttcaccgtatgggcgcagctctccggctcgcccgtgaccttctcccttgccacgccaattgcactctag

SEQ ID NO: 39 - protein, 2880 aa, Aspergillus nidulans
MTQILHVSPVGWDHMKNHWWQFSRRRPEKVSPRVSAKIDGLANRHLNLANRPTGQKPSSVGIYLGGLDEHLSDYQRRFLDEWDMLIVDPYQSGVVEAVATAAGKQILGRLDLQDVASKEDAALAAIEKIDSALSQVFERSAFSGILLANWENKLSSECWASLLQAIQKLGLSVFLETAPPDFLPDRLVLQNQAISGLVVKNASILPNGQKRDYFQLQSMKSTIKAFVSEACMRDFTVVAWETIDDDASLSNAVVRRSLQWCNFYSAIPWIGCRAALKDVKLNTKLPEPLSSFSWLKEPEIMSAHDRWRANSSIEDVNGVVSSGWDELLPFFPTLSNLIASSERDNGAHEDLTMAIRDPPDWVSLTKSQTNPLSTSIGGLEYNSFGCFPLGAEATAGSFAEILKSQQRLKSLGLLHPVPLAKMQSLATLLRQFHDGFALSAWGSSDPVPGHIKELSNLAANEQLRVYLGLDSGFRKNTDIRFWGVYHMDSEGFDVFVSKKVQGLAGTVLHTYLSAKGCPRHVCFGAETALAKWTKDLVEEIGLPRRLVQDIDVLSPEERLLLLQHLSLTDAPSDLTKSICAYLQQQLIEGTSLVQLKQVNTVSYLEGSASPETLVNSRVKWYREQGCSYPSPSVCLSLFREVEATFPQILKERREADLAQISRGLCQLMQGKQVDAYTDILALALFCAARKGALDEIYQEVTDRNPLFNAHSDQAAAFAESFALGSRCESYFDISPSAFGKLLSDRFRKSYKDGDLPDWINGAPEMATSYAGAQIDVNPDDKVKPMRGYQRFTFLSVFAFPALIDIILLTLIGRGLYLSAFMTYEEQNSATTALMISLLLSGGIGTWIACGGPYYLISMAFAATNMFVFIRLIAGLAFTIAGGLIGFVVVSGVNGPRAGIVFYLYLVALTTYFSGFACLASFSYPGSTFLSGRKIIFACIPILFISPIVTTFTGHDSAIYIAVIYVFIGALILGLRSVASKWVTWYQKLRKTDDTEIRKWYVETYGNGDEKVFGGLSDPAVLKLSREALLKDVTAERNRWFFSRPTTKSTLVLELARDWEATNFLLEWYCRYADVPRPIPYSSGWNTQTKVALESLKAAQRGIRLHNAFIHWRQSSREIGCGMLYFIVALLDKWVELLSGGHLIGLSASLTTAYRMAVGFSLAYYLIGAVLIDTKAQELHSLVGSHTPVPLKTAKDIRDSQKRDVRFKRKVYWKTLGKYLMWHSWGLAFSTALVWTFQSHMEAMVMFLSYVAAYTGLLWYQYTKIFTGPHALKPLLVGSLVGLPLGIALKVCLPHFMYSQVVGLGAATWTVAFLSLIPAKMGMPKRVDSPVELGKTFHAYTAPWDDPDWSQQELQTFYESISLIPSDARLKLVPASHPGSEVKQMLISRRKEPRIEEAFPHSQELVDTALKAWEAGEVLLELVPLGSIGPNVHALSCSTSDHLKIAIAVGRGLDHRIDVSANCQVIAETLLHAVAESIMQIPHEQAVLAESLVAAGVTETTARQLREEADTPLVVRWAKKELLRQLCLGFECDFHWEKLPRAVRKALLDRCLGQPCRLSEKHYRWLEESICQFDIKDLAVHIARSNLAAAAAVSILDYANYGTGESATYKESETPAYIPYLPKQLPTVAYFIMKPLFSVYYKVAIALKFVVVALVADPEFQREYNHVMSPYPAIIRVPATFALSMVWNYAKIMQDLGLTFFLFHGRDNVKQLWDETKGMTINIKKSRYIVQSLDGTFTAFRHNQPDGGFKVYYYTGTPKTEPQGTKSLSCVSTYSKDLLLLIRQEYKGGNIVNEYHYDYRTPTKKGITLKLTDRKVPMGRRCVRGTNHLQSVQYNRKGLIEAGSYMKDGNLIRFKYHYRKNPQFGDELLRAEFALSHITCTVSWCAPPLRHPEKVDRWIPHAKVTEATFVQGPDVYEARWLYDHKFHPTIFTTLNGQKIQTPPMIEHDYLGVLAKPRLTSFVHDNPLFYCDSLSSNIFTRILGLTRKRFPVSISRARSLIWKAWKEKADFDGITVRWMDERLLRRDRTLSPYWRSRDWGDLTSAKKYLELRADTIAASADLDDGISSWTPLAVKVSDLFNFGPGGDAVVNTRSNDFGSDTEKSLHVMAADNGTWPNEGGGVSACRRDMINSLRTIKWHMICESANDFGVPKHQTEQNILSLKVIPLWGMDFLTPTHGLFRNKLDAEVESVTSANDMDIKMNFIPILTALVKGARAVHLSKADIRQATRALVNLNTFFQDSRHWTQIWNSEIVKESWRDLWLTQEMPNTMPSAEWFSTDLPTLGTLDVALELWYRYLFIFSIPIPEKIPSVFQASHHSVSASYGVVCKIKRNCTLQIWDHAIAWRETNLCLSSALCKLSPFVRNALLGLMRVTSALTLYHADIISPCADFFNPGWEVEIGTCQGTIEHRNIFRRKVDPVVNGITDMQKFAPVKEIKSERPTVTMLSHVWYAKDIKTALLAADIIINQWKFDDYHLDIYGAIDKAPTYSTECQEIIASKGLRGRVTLRGTADPMKVLESTWLFLNSSLSEGLPLALGEAALTGAPVVCTDVGASLRVLSDPDDFSRFSAVVAPNDALALARAQISMLALLGEWSQYAEDTEPAPILPSSPTPEDVAKITQRMYDKSEHRRKLGMMTRKIVQKSFSGDRYLREHEQMLWIGKSAKMMATRAPGLHEPADIATAIQQTLPIEEEVITIPRSAVHSWRSSAASGMSTLYTSYTSSTTPFSHLNPNNQPPTRSSYYAPAHTSASANLLTRPSSLYSAISNASTTDASSFLPLPNTPLPVFAPRHSFALPSAPGANGGNGGGISRPLSPAGRRSPLFTRARHSRSRSGSLSTGGREQLRGLQREDLQQYRNSDVSTIMREDFFQSSIYRGIEGGNNQV

SEQ ID NO: 40 - DNA, 8847 bp, Aspergillus nidulans
atgacccaaatcctccatgtctcgcccgtcgggtgggatcatatgaaaaatcactggtggcagtttgtgagccccctgatccatgcatcctccaatttcttttgttaatgcttctaggttttgattggtattctactgggcagcgttacagttggaacagtataccttgtatattcttcagtactacgatgcataatttatttggaggtaaactaaacacctttttacatgcataccgctgccacatggaccttgctgacttccgtctagtcaaggcggcgccctgagaaggtgtcccccagagtatccgcaaagatcgatgggttggcaaacaggcatctcaacttggccaaccgcccaacgggccaaaagccctcgtctgtcggtatctacttgggaggcctggatgagcatttgagcgattatcaacgtcgcttcctagatgagtgggatatgttgattgtcgatccctatcagtcaggagtagtcgaagccgttgcaactgctgcaggtaagcagattcttggccgactcgatcttcaggatgtggcttccaaggaagatgcggctctagcggcaatcgagaagatcgacagcgctctgagtcaggtctttgagagatccgccttcagcggtatcttgctcgccaactgggagaacaagctctcctctgaatgttgggccagcctgcttcaagccatccaaaagctggggctgtcagtcttcctggagactgcgcctccagacttcctcccagaccggcttgtgctacagaaccaggccatctccggcttggtcgttaagaacgccagcatcctccctaatggtcagaagcgggattacttccagctacagagcatgaaatcaacaatcaaggcttttgtgtctgaggcatgcatgagagattttacagtcgtggcttgggaaacgattgatgacgacgcctctctatcgaatgccgtggtccgaaggtcgctgcaatggtgcaatttctacagcgcgatcccttggatcggctgtagggctgccttgaaggacgtcaagctgaatacgaagctgccagagcctctttcttccttcagctggcttaaagagccggaaatcatgagcgcgcacgatcgctggagggccaattcatccatcgaagacgtcaacggtgtcgtcagcagcggatgggacgagttgctgccattcttcccaaccttgagtaacctcattgcatcgtcagaacgcgataacggcgctcacgaggatcttaccatggcaatccgtgaccctcctgactgggtttctttgaccaagtcccaaaccaaccccctctctacttctatcggaggactagagtacaactcgttcggttgctttccattaggcgcggaagccactgcgggctccttcgccgagatcctcaagtcccagcagcgtctcaaatcgctcggcctgcttcatccagttcctcttgccaaaatgcaaagtctggcgactctcttgcgtcagtttcacgacggattcgcgctttcggcctggggctcctcagatccagtccctggccatatcaaagagctttccaatcttgctgccaatgaacagcttcgtgtgtatctcgggctcgactctgggttccgtaaaaataccgatattcgtttctggggtgtatatcacatggactccgaaggattcgacgtatttgtgtcgaagaaggtgcaaggcctcgctggcactgttctgcatacttatctctctgcaaaaggctgccctcggcatgtttgctttggagcagaaactgcattggccaagtggaccaaagatctcgtggaagaaattggcttgcctcgtcgcctggtgcaagatatcgacgtcctgagtcccgaggaacgacttctgctcctgcagcacctatctctgacagatgcaccaagtgacctaaccaagtcgatttgcgcgtacctccagcagcagctcatagaagggacatctctcgtacaacttaagcaggtcaacacagtctcatatcttgaagggtctgcatctccggagacattagtgaattctcgcgtgaaatggtaccgagaacaaggctgcagctatccttcgccctcggtatgcctgtctctcttccgtgaggtcgaggcgaccttccctcagatcctcaaggagcgccgcgaagccgatcttgctcagatctcgcgtggtttgtgccagttgatgcaaggtaaacaagtcgacgcttatactgatatcttggcccttgcgctgttttgcgctgcgcgaaaaggagcccttgatgaaatctatcaggaggtgactgatcggaacccattgttcaatgctcattccgatcaggccgctgccttcgccgaatcctttgctcttggatctcgctgcgagtcctattttgacatctcacccagcgctttcggaaaattactgtctgatcggttccgcaagagctacaaggacggagaccttccggactggatcaacggcgctccagagatggctacatcgtatgccggcgcccagatcgatgtcaatcctgatgataaagtcaagccaatgcgcggatatcagcggttcaccttcctcagtgtctttgccttcccggccttgatcgatatcattctccttaccctcattggacgtggactgtacctctcagccttcatgacttacgaagagcaaaatagcgccaccactgccttgatgatttcgctactgttgtctggaggcattggtacctggattgcttgcggtggcccctactacctcatttcgatggcttttgctgcaacgaacatgttcgtcttcatcaggcttattgccggtctagcattcactatcgccggtggcctcattggatttgttgtggtgtcaggcgtgaatggcccacgggctggaattgtcttttacctctatcttgtcgccttgaccacctacttctccggatttgcctgtctcgcgagcttcagctatcccggctctactttcctgtctgggcgcaaaatcattttcgcatgcatccccattctgttcatctcgcccattgttaccacctttaccggccacgactctgcgatctacattgcggtcatctatgttttcatcggagctctgatattgggtctgcgaagtgtcgcttcaaaatgggtaacctggtaccaaaaactgaggaaaacagatgacacagaaatccggaaatggtacgtcgaaacatatggaaacggagatgagaaggtatttggaggtctcagcgacccagccgtgttgaagctgtcgagggaggcactcctgaaagatgtaacagcagagcgtaaccgctggttcttcagcaggcctacgacaaaaagcacccttgttcttgagctcgcccgggactgggaagccacgaacttcctcctcgagtggtattgcagatacgcagatgttcccagaccgattccctatagctcggggtggaacacgcagaccaaggttgcactagagtctctcaaggctgcccaacggggtatccgcttgcacaacgcttttatccattggcgtcaatcaagcagggaaatcggctgtggaatgctctacttcatcgtcgcccttctggacaagtgggtggaacttctcagcggtggccaccttatcggtctctcagcgtccttgacgacggcttaccgaatggcagtcggtttttcgttggcctactacttgattggggctgtgttgattgacaccaaagctcaagagcttcacagccttgttggaagccataccccggtgcctctcaaaaccgctaaagatattcgagactcgcagaagcgagacgtgaggttcaagagaaaggtctactggaagacacttggcaagtatcttatgtggcattcatggggccttgctttctcaacagcccttgtatggacgttccagtcgcacatggaggcaatggtcatgttcctctcgtacgttgcggcgtacaccggcttgctctggtaccagtacacgaaaatatttactggccctcatgcgctgaagccgctgttggttggctctctcgtcggcctaccgcttggtatcgcgctgaaggtctgccttccgcacttcatgtactcgcaagtggtcggcctaggagccgccacatggacagtcgcattcctctcgctcataccggccaagatgggaatgcctaagcgcgtcgactccccggtagagcttggcaagacgttccacgcttacaccgcaccctgggacgatcccgactggagccagcaggagctgcaaacattttacgaaagcatttctctcattccctcggacgctcgtctcaagcttgtgccggctagtcacccaggatcagaggtgaagcaaatgcttatctcgcggagaaaagagccgagaattgaggaagcgttcccccactcccaggaacttgtcgatacggcgctgaaagcctgggaggctggcgaggtcttgcttgagctagttcctctaggctcaattgggcctaatgttcacgcactgagctgtagcacttctgaccatctgaagattgctatcgctgtgggaagaggactagaccatcgcatcgacgttagtgccaactgccaggtcattgccgagactcttctccacgctgttgccgagtcgataatgcaaataccccatgaacaggcagtgctcgctgagtcgcttgtggctgctggtgtgacggaaaccaccgcccgccagctgcgcgaggaagctgacacgcctcttgttgtacgctgggccaagaaagagcttctgcgccaattatgcttgggcttcgaatgtgactttcactgggagaagctgcccagggccgttagaaaggctcttcttgatcgttgccttggccaaccatgtcgactttccgaaaagcactaccggtggcttgaggagagcatctgtcaattcgacatcaaagatctagcggtccacatcgcccgcagcaatcttgcagctgcagcggccgtcagtatcctggattatgccaactacggaacaggtgaatcggcgacttacaaggagtccgagacacccgcatatatcccttacctgcccaagcaacttccgacagtggcttactttatcatgaaaccgctgttctcggtgtactataaggttgctatcgctctcaaattcgtggttgtcgccttagttgccgatccggagttccagcgagagtacaatcatgttatgagtccttatcccgccatcattcgggtgccggctacattcgcgctgagcatggtctggaattatgccaaaatcatgcaagacttggggcttacattcttcctattccatggtcgtgacaatgtcaagcagctctgggatgagacaaagggtatgacaatcaacatcaagaagagcaggtacatcgtgcagagtctcgatgggacattcacagctttccggcacaatcaaccagatgggggattcaaagtctactactacactgggactcccaagacagagccgcagggaacgaagagcctcagctgtgtcagtacatactcgaaagacctcctgctgctcattcgccaagagtacaaaggtggtaacattgtcaacgaataccactatgattaccgcaccccgacgaagaagggtatcaccctgaagttgactgacaggaaggtcccaatgggccgacgatgcgtgcgcgggacaaaccatctccagagcgtacagtacaatcgtaaaggactcatcgaggctggctcttacatgaaggacggcaatctcatccgcttcaagtaccactaccgaaagaatccccagtttggcgatgagctgctccgggctgagttcgccttgtcgcatattacctgcactgtgtcgtggtgtgcaccgccgctccgccaccctgagaaagtcgaccggtggattcctcatgcaaaggtcaccgaggcgacctttgtccagggccctgacgtctacgaggcacgctggctgtacgatcacaagttccacccgaccatcttcactacgctcaacggacagaagatccagaccccgccgatgatcgagcatgattatcttggagttctagcaaaacccaggctcacgagctttgtgcatgacaatcctctgttctattgtgacagtctcagctctaacatctttacccggattcttggattgacgaggaaacgcttcccagtttcaatttcgcgtgctcgttcacttatctggaaagcttggaaagagaaagctgactttgacgggatcaccgtgcgctggatggacgaacggttgctgcgaagagacaggacactatcgccatactggcgcagccgtgactggggtgatcttacatcagcaaagaaatacctcgagctcagggctgataccattgcggcgagcgcagatcttgacgatggcatttccagctggacacccttggctgtcaaagttagcgatctcttcaacttcggtcccggaggtgacgctgtggtcaacacgaggtccaacgactttggatcggacacagagaagtcccttcatgtcatggcggcggataatggtacttggcccaacgaaggaggtggtgtttctgcttgtcggcgggacatgatcaactctctgcgcacaatcaagtggcatatgatctgcgagtcggcgaacgatttcggcgtgccgaagcatcagacggagcagaacattctctcgctcaaggtgattccgctatggggaatggacttccttacaccaacgcacggcctcttcaggaacaaattggacgcggaggttgagagcgtcacgtctgcgaatgatatggatatcaagatgaactttattcccatcctaacagccctcgtcaagggagcccgtgccgtgcatttgtccaaggccgatatccgccaggcgactagggctttggtcaatctcaacacgttcttccaggactcgcggcactggacacagatttggaacagcgagatcgtcaaggagagctggcgggatctgtggcttacccaggagatgccgaacacgatgccttcggctgaatggttcagcactgacttgcccacgttgggaaccctcgacgtcgcgcttgagctttggtaccgctatctgttcattttctcgatccccatccccgagaagattcccagcgttttccaagcgtctcaccatagtgtaagtgcttcgtatggtgttgtatgcaagatcaagagaaattgcacgctgcagatctgggatcatgcgatcgcctggcgtgagacgaacctgtgcctctcgtccgctctttgcaagctttccccgtttgttcgaaatgcgctactcggtctgatgcgagtcacatccgctctcactttgtatcatgccgatattatctccccgtgcgccgacttcttcaacccaggctgggaagtcgagattggaacatgtcaaggcacgattgagcaccgcaacatcttccgccgcaaggtcgacccagtcgtcaatggtatcaccgacatgcagaagttcgccccagttaaggagatcaaatccgagcggcctacagtgacgatgctttcgcacgtctggtacgccaaggacatcaagaccgcgcttctcgccgcagacatcatcatcaaccagtggaagttcgatgactaccacctcgatatctacggtgcaatcgacaaggcccctacttactccaccgaatgccaggaaatcatcgcctccaagggtctccgaggacgagtgaccctgcgcggcacagctgaccccatgaaagtcctcgagagcacctggctcttcctcaactcttccctgtctgaaggtctcccactcgctctcggcgaagcagccctaactggtgcgccagtggtttgcactgacgtgggcgcctcccttcgcgtcctcagcgacccagatgacttctcccgtttcagcgccgtcgtcgcccccaacgacgcactggcgctcgccagggcccagatttccatgctcgccctcctcggcgaatggtctcagtacgccgaagacaccgagcccgcccctattcttccatcatcacccacgcccgaagacgtcgcaaagatcacccagcgcatgtacgacaagtcggagcaccgccgcaaactgggaatgatgacccgcaagatcgtccagaagtctttcagcggtgaccgctacctccgcgagcacgagcagatgctctggattggcaagtccgcgaaaatgatggccacgcgtgcccccggcctccacgagccggcagacatcgcaacagccatccagcagaccctccccatcgaagaggaagtcatcaccatcccccgcagcgccgtacactcctggcgctcgtccgcggcctctggtatgtccaccctgtacacgagctacactagctccaccactcccttctcccacttgaaccccaacaaccaaccacccacccgctcaagctattacgctcctgcacacacatccgcatccgccaacctcctcacccgcccatcctccctctactccgccatctccaacgcttccacaacggacgcctcctccttcctgccgctccccaacaccccccttcccgtttttgccccgcggcactccttcgcccttccctctgctcccggtgccaatggcggaaacggaggcgggatttcacgccccctatcgcctgcaggtcgaaggtccccgctcttcacgcgcgctcgccattcgcgatcacgctccggtagtctctctacgggcgggcgggagcagctccgcggcctacaaagggaggatctgcagcagtatcgcaattccgacgttagcaccatcatgagggaggacttcttccagtcgagtatctaccgcgggatcgagggtggaaataaccaggtttaa

SEQ ID NO: 41 - protein, 428 aa, Aspergillus sojae
MESLQQSDASTPVEPYSPECVDTPATQSSVLFDGNLEELLRNFPLDQYILVTGGLGFIGSHTTLELLKANYNVIVIDNLSNAFQNVFDRIKLLASKHHEQQGTKMPEMHLHAHDYRDSVALRKLLEQYQIQSRWGTPKTKISGVIHFAAHKAVEESIRNPLKYYANNVGGLIDFATTLGEFGIKTFVFSSSATVYGTLATSGLPLKEELCVHKDEIFEDRDGSKKLMEPGCTGITNPYGRTKWICEAILADLAASDPEWTIVALRYFNPVGCDESGLLGEDPKQIPTNLLPVVVKVMTGQYKELQMFGTDWDTEDGTAVRDFIHVTDLARGHIAALSAANEGKLKENFRTFNLGTGTGHSVMEVVNTMESVSSKEIPRRAADRRAGDVGSCVAVATRSQEELQWKTEKTLTDACASLCNFLTVSGLSS

SEQ ID NO: 42 - DNA, 1287 bp, Aspergillus sojae
atggagagcctccaacagtctgacgcaagtactcccgtggagccttattctccagaatgcgtcgatacaccagcgacgcagtcatccgtcttgttcgatggaaatcttgaagagttgctgcgcaacttccccctggatcaatacatcctcgtcaccggcggtctcggtttcattggaagtcacacaacattggagctactcaaggccaattataacgtaatcgtcattgacaaccttagcaatgctttccagaacgtcttcgatcgcatcaaactcctggcttccaagcaccatgagcaacaaggaaccaagatgcccgagatgcatctgcatgcccatgattaccgcgacagtgttgctcttcgcaagcttcttgagcaatatcaaatccagtccaggtggggtacacctaagaccaagatctccggcgtcattcactttgctgcccacaaggcagttgaggagagtatcaggaatcctttgaagtactacgcaaacaatgtcggcggtctcatcgactttgccacgacgctgggtgagtttggtatcaagaccttcgtcttctcgtcgtccgccaccgtatacggaactctagcaacttccggtcttcccctcaaggaggagctttgtgtccacaaggatgagatcttcgaagaccgtgacgggtccaagaagctcatggagcctgggtgcacaggtatcacaaacccctatgggcgcacaaaatggatctgcgaagccatcttagccgacctcgcggcctccgatccagagtggacaatcgtggctctacgatacttcaacccggttggatgcgatgaatccggccttctcggcgaagatcccaagcaaatacctaccaaccttcttccagttgtcgtcaaggtcatgactgggcagtacaaggagctgcagatgtttggaaccgactgggacacggaagatggcacagctgtccgtgacttcatccacgtcaccgatctggctcgaggacatatcgcagccctcagtgctgccaacgaagggaagctcaaggagaatttccgcacattcaacctcggaaccggtacaggccattccgtaatggaggtggtgaacactatggagagtgtgtcttccaaagaaatcccgagaagagctgctgaccgccgcgcgggcgatgtcggttcctgcgttgctgtggccaccaggtcacaggaagagctgcagtggaagaccgagaagacattgaccgatgcctgtgccagtctgtgcaatttcctgactgtcagcggactgtcctcttag

SEQ ID NO: 43 - protein, 301 aa, Aspergillus sojae
MGPDKHVSGRRCLQSRRSRIILGVFVFIAILAVVIPPAVVVTLRKKNSMGPKANIFVPLYVYPAPGAWDPLEAEISSHPEANFTVVINPASGPGPNALPDANYTREIPKLASYDNVRLLGYVPTTWAKRNISAVRRDIATYAEWPTNSSNPKLAVRGIFFDETPQQYDADALSYLQELTSFVKGLSGLGPDNFIVHNPGAVPDSRYMSSADSTVVFEAAYDTFNERNGTKQFDVLPKSDRGRGQLCIVIHSVPDEVEGSKLRELVKKLRKTADEIFITHLSTDYYANFGDRWGEFVDWMAK

SEQ ID NO: 44 - DNA, 1714 bp, Aspergillus sojae
aatccactttcttgccctcctttcgttgcatactccggagtactaaggcattcacattttaattgcctccctaacgtgggaacgatggggccagacaaacacgtgagcggtcgtcgctgcctgcaaagccgacgttctcgaatcattttgggggtctttgtctttattgctatcctcgcggtcgttatacctcccgcagtcgtggtcaccctacgcaagaagaacagcatgggccctaaagctaacatcttcgtccctctctatgtgtatcctgcccctggcgcctgggatccattggaagcagagtatgtctgaatatttttttatgcctatttgtatttctaattcttcccttccatttcacccccactacttcccctcacccccaaaagcccagtatgttctggtccctggtatatacattgtacaccataagcaagctgaaagccaattgcatgatgcatgcaagtgggaagctataatttgggggaaagtaactaagcgccacaggatctcttcacatccggaggccaactttaccgttgtgattaatcctgccagcggcccagggcccaatgccctgcccgatgccaattatactcgagagattcccaagctcgcctcttatgacaacgtgcgtctcttgggttatgtccctacaacctgggccaaacgcaacatctcggccgtgcgtcgcgacatcgcaacctacgcagaatggccgaccaacagttccaaccctaagctcgcggttcggggtatattctttgatgaaacgccccaacagtatgatgccgatgcgttgtcatatttgcaagagctcacctcattcgtgaaaggcctttctggtcttggtccagacaactttgtacgtgtgacccttctctttcacccctctgtaatttgtattaccgctcggtattcatggtaatttacatgggtacatacctcatgcccccgtaccttctccaccctctgtgtactttttatgctttttcacttttgccaatatggtccatacctgcctttttgctaggttctattacggttttcgactgcaactccgacaacctcattgggtcaattttatcaacgatgatgctaatagtggctgtctagattgtccataacccgggagccgttccagactctcgttacatgtcttcagctgactcgactgtcgtattcgaagcggcttatgacaccttcaacgagcgtaatggcacgaagcaattcgacgttcttccgaagagcgatcgcggtcgcggtcagctctgcattgtgatccactccgttccggatgaagttgaaggttcgaagcttcgtgagctcgtcaagaagcttcgcaagaccgccgatgagattttcattacccacctgagcacggattactatgccaactttggggataggtggggcgaatttgtcgattggatggctaaataatccctacgggcggcgcttttcgagcatacctgatgcaacattgcttatgatcaggacccgattggcgtcgactgataatatatgcgccggcgctttgatggattggattgactaatcaacttacgacctgtctatactgtatgaacgtctatatcctgtatggttattctgctgataatatgctatttgactttggccgttgtgactatcaaatgatacctagaattacgatagagtttacgatcgtcaagatttcctttttgttgtc

SEQ ID NO: 45 - protein, 320 aa, Aspergillus sojae
MAGIDEALPLKGKGQAASGWKTWSGKKRMLIIGAIALVIALAIGLGVGLGVGLNKGGGEDEGEVPPTTGGGVTTAKWQPAVGTKWQIELLYALNDTSVDADIYDIDLFNNNKSTINDLQKQGRKVICYFSAGSYENWRPDKDKFKDSDMGNTLDGWPDEKWLDLNSKNVRSIMTSRLDMAVEKNCDGVDPDNVDAYDNDNGLDMKKEDSANFMMWLANETHARNMSIGLKNAGAIIPAVIDNMQWSVNEQCAQYEECDTYAAFIDKNKPVFHIEYPKGDDTNNNDLVSTSQKKSACDFEGSSNFSTVIKNMNLDNWIQTC

SEQ ID NO: 46 - DNA, 1594 bp, Aspergillus sojae
ccgcaggtgacctcgaaacaacagccactgtggcagagtccattgtttggacagcgactgccgcagtctgtaaggcattcacttgcctttaattccaacccagggcaggcgtctctgcatccgattccccggaccacctcaacgcaatctctgaacaagccacttcatagtttcagtgtaaccgcggagagagggatttctttgtcctctcctagcctatacatttaacggttgcctgtgaacccctgtggttctactccggaatacgccactctatttgcttctttatctgatcgtttgatcttcatctcaggtcctctttatattttccttgcttaccccccacccaccttaccgctgtggtttgtgaaaatcaaatcgcaggtcgtacctttctttctcagaattcccttctttgaacatttctttctttagcccttcattttattggaatttttctttgtgaaatctattgtactatggcgggtattgatgaagcgctgcccttgaagggcaagggacaagctgcgtccggctggaagacttggtctggcaagaagcgtatgctgattatcggcgctatcgctctcgtgatcgctctcgctattggtctaggagttggcttgggagtcggtctgaataagggcggaggggaagacgaaggcgaggttccgcccactaccggaggaggcgtgaccacagccaagtggcagccggccgtaggaacgaaatggcagatcgagcttctgtacgcgctcaacgacacttcagtagacgcggatatctacgacattgatctcttcaacaataacaagtcgaccatcaacgatctgcaaaagcaaggccgcaaggtgatctgctacttctccgctgggagctacgagaactggaggcccgacaaggacaagttcaaggattccgacatgggcaacacgctggatgggtggccggatgagaaatggcttgacctcaactccaagaacgtgcggagcatcatgacgtcgcgtctggatatggcggtcgagaagaactgcgatggagttgacccggataacgtcgatgcctacgacaacgacaatggtctcgatatgaagaaggaggattcggcgaatttcatgatgtggctcgccaatgaaacgcatgcacgcaatatgtccattggcctgaagaatgccggggcaatcatccctgcagtgatcgacaacatgcagtggagcgtgaacgagcaatgcgcgcaatatgaggagtgcgatacctacgccgcattcatcgataagaacaagcccgtcttccacatcgagtaccccaagggcgacgacaccaacaacaacgatttggtcagcacgagccagaagaagagtgcttgcgactttgagggatcctccaacttttcgacggtcatcaagaacatgaatctggataactggatccagacctgctagtcgcacaattgatccgcatctagatactctgttcgatcagcaagggcgccgggagtttgagattgggatttccaccatccccttaccatctatatagtttgactatgatgtaatctgcctcatttaattaactttgacattcgtctctttca

SEQ ID NO: 47 - protein, 795 aa, Aspergillus sojae
MVLPWLLRTGCYFGLITCDTPPGVWPEGIPSVIAPVPPSRTSGVTTNSPGFTSSVLSFTSSSSPPVTGSSSFVTITTTLASSTSTSTSTSLPSFTSTLVSVSTPVSASSTMSLIPSPSSSLIPSATPSASVIANGNVAGNILVIAKDTAAANVATSGLNGYGIPFTTLLVPQSGATLPELNGTSGGNFGGIVVASEVSYDYGAQGFQSALTTDQWNQLYAYQLEYSVRMVQYDVYPGPNYGASAVGGGCCDSGVEQLVSFSDVSDFKEAGLKTGAGVSTTGLWHYPASVNDTATTKEIARFAANGNYGSETTAAVINNFNGRQQMAFFLSFDTTWSATSNYLQHAWINWLTRGLYAGHRRVNLNTQIDDMFLETDIYYPNGTTFRITTADMDGISSWLPTINGKMNAGSSYFVEVGHNGNGVIESATGKDADACNGGGIEYDSPADTPLEFKKPLGTGTDLWPKDQTEYNWTTECTKLDDLFVWWTTPANRDKFGHISHTFTHEEQNNATYNDVKREISFNQAWLRQSGFYDAKYFTSNGIIPPAITGLHNGDALRAWYENGITNCVGDNTRTPLLNQQNGMWPYFTTSASDGFDGMQVNPRWATRIYYNCDTPACTVQEWIDTSAGSGDFSNLLATEKADTMRHLFGLHRDPYMFHQANLRNVDVDPVEINGETGQWSIMQAWVETMVQEFVRLVDWPIVTITHQEMSANFLDRYNRDQCNYSLQYTIGNKQITGVTLSAKDNTCNAPIPVSFPVAPTDTKGFTTEQYGSDPLTVWVQLSGSPVTFSLSTPIPL

SEQ ID NO: 48 - DNA, 2612 bp, Aspergillus sojae
atggttctaccgtggttgctgagaactggttgttacttcggacttataacttgcgacactcccccaggtgtttggcctgaaggtatcccaagtgtgatcgctcctgtgcctccctcacgcacatctggagtcacgaccaactctcccggctttacttcgtcggtcctgtcgttcacttcttcttcttcccctcctgtcacggggtcatcgtctttcgttacgattactactactctcgcttcctccacatccacttctacttcaacctctctaccttcgtttactagcacactcgtttctgtcagcactcccgtgagtgcctccagcacaatgtctctaattccttctccttcgtcgagtctcattccttccgcaacaccttccgcttcggtcattgccaatggtaatgtcgcgggtaacatcttggtgattgcgaaggacaccgcagctgctaatgtggccacctcgggcctcaatggctatggtattccttttactaccttgctcgttccccagtctggtgctactctaccagagctgaacggcacctccggaggaaactttggcggtatcgtggttgcgagcgaggtcagctacgactatggtgcccaaggcttccagagcgctctgactaccgaccaatggaatcaactctatgcctatcagctcgagtacagtgtacgcatggtgcagtacgacgtgtacccgggacccaactacggtgcctcggccgtgggcgggggatgctgtgactccggtgtagagcagcttgtttctttctcagacgtcagtgactttaaggaagccggcctgaagaccggtgccggtgtcagtacgacaggcctctggcactacccagcctcggttaatgatactgctaccaccaaggaaattgctcgtttcgccgccaacggtaactacggcagcgagaccactgctgcagtcatcaacaactttaatggcagacagcaaatggctttcttcttgtcttttgacactacctggagtgcaacttccaactacttgcagcacgcatggatcaactggctcactcggggtctctacgctggccaccgtcgcgtcaacctgaacacccagattgatgatatgttcctcgaaactgatatctactaccccaatggaacgaccttccgtattaccaccgctgatatggatggtatctcgagctggctcccgaccatcaacggcaagatgaacgccggtagctcatactttgttgaggtcggacacaacggtaacggtgtcatcgaatccgctaccgggaaggatgccgatgcctgcaacggaggtggcattgaatacgactcgcccgctgatactcctctggagttcaagaagcctctgggcaccggtactgacctttggcccaaggaccagaccgagtacaactggactactgagtgcaccaagttggacgatcttttcgtctggtggaccaccccggctaaccgcgacaagtttggtcacatctctcacactttcactcatgaagagcagaacaatgccacctacaacgacgttaagagggagatctctttcaaccaggcttggttgagacagagtggtttctatgatgccaagtatttcacatccaacggtatcatccctcccgccatcactggattgcacaacggcgacgccttgcgggcctggtacgaaaacggcatcaccaactgtgttggtgataacactcgtacaccgctcctcaaccagcagaacggtatgtggccttacttcactacctccgcatcggatggattcgatggtatgcaggtgaacccccgttgggccactcgcatctactacaactgtgatacccctgcctgcaccgttcaggaatggattgacacctccgccggcagcggcgacttcagcaacctgctcgcgaccgagaaggccgacaccatgcgccatctcttcggtcttcatcgcgacccttacatgttccaccaggccaatcttcgcaatgtcgacgttgacccggttgagatcaacggcgagactggtcaatggtccatcatgcaggcgtgggtggaaaccatggtgcaggagttcgtgcgtctggtagactggcccatcgtgaccatcacccaccaggaggtaagtcatggagatcttagaaactcctcccaacaccccgcaattgctaactaatcaccccagatgtccgccaacttcctcgaccgctacaaccgtgatcagtgcaactactcgctgcagtacaccatcggaaacaagcagattactggggtgactttgagcgccaaggacaacacctgcaatgcgcccatccccgtcagcttccctgtcgcccccaccgacaccaagggcttcaccaccgaacagtacggcagtgacccactcaccgtctgggtgcagctgtcgggctccccggtcactttctccctctcgactcctattcccttgtaaatggattgaacgatactgaattatggaagggctttgaaggattcctggaccataatatctaatgttattaatgggtttcgtgtagcgatttcgaatatgggaagagatgaatgaaatattaggtacatacatacatagctacattgcatacatactacata

SEQ ID NO: 49 - protein, 2884 aa, Aspergillus sojae
MAEILHVSALGWDKMKDHWWQFVFIAILIACVATGSLWLLYSGTKRLRNYIKTRPRSEKVPPNVSQRLVTLSNKLLSVPNIQRRKPSSFGVYLGSFSSPPDRDQLRLLNEWDLLIVDPFQSGTAQAIRYVEGKQLLGRVDLDRILSKDESTLSAIEKIENLLTGTFDSANFSGMVLANWEGKFPAPVFTKLVEVIDELGLAVYLETAPPDFLKDHTSMQNPAISGIVIQNASILPEGQKRDYFQLVKMQPTIKAFVSEACVRDFVVMAWETIDDNASLSNAVVQRSLQWCNFYSAIPWIGQKSALTNAALNVKISEPLSSFGWLKDAEIIKAHDRWRSNLHLKDDASDTSAWNTLLPFFPTLEELLTSSEYGQPESNELTTKLRDPPEWVAQVKSLGSPLSISMAGIEYNSLGCFPLGSEATALAFAEVLQSQLRLKSLGLLHPVPASKIQSIGLLLKKFHESYLLPNATSSDPYVIPNATSDQLATTIKELSNLATNGSLQVNLGLDSGLRKSVDVRFWAVYQMDSDGFEVFASKKAQGLAGTVLHTFLSAKGYPRHVCFEVETALAKWSKDLVNDTGLPRRFVEDIDMLSPEERLLLFQHLSLTDSYSELSDTICAYIRRLLIDAPSLAQLKELNTISYLEGSASPEILVNTRIKWYREQGCQHPSPSKCLALFYQTDAAFTQILREHREGDLALISKGFCQLLQNDHIDAYTDIMALALFCAARKGAIDEIYTEVTDRNPLFNNQSDQAAAFSESFALGSRCEVYFDVQPSAFGKLLSDRFRREYNDEKLPDWINGAPEMATSYAGAQIDVNPDDKVKPMPGYQRFTFLGVFAFPALIDIILLTIIGRGLYLSAFMTHDELQSATIALMISLLLSGAIGTMIACGGPYYLISMAFAASNMFVLIRLIAGVAFTIAAGLIGFIVISGVKSPQAGIIFYLYLVALTIYLTTFATLASFSYPGTGFLSGRKVIFSCIPILFVSPIITTWSGHDSAIYLAVLYVFIGFLLLGLRSVASKWVTWYQNIRRTDDTEIRKWYISTYGNNDEKVFGNMSDPAVLKMSRDALFKDVLAEKSRSFFSKPTTDTLVRELARDWDSTNFLLDWYCRYADVPRPIPFSSSWNIQTKVGLDVLRNSQKGIRLHNAFIHWRQSSKEIGCGILYFIIALLDKWVELLSGGQLVGLSTSLSDANRMAVGFGLAYYLIGAVLIDTKAQELHDLVGQHSAVAVGSAKEIRPSQKRDVRFKRKVYWKTFFKFLMWLVWSLAIATALIWTFQAPVQAMIMFFAYVLSYTGLLWYQYTKIFTGPHALIPLMTGVVVGLPVGIALKVCLGNNFLYSQVIGLGAATWTVAILSLFTAKMGMPKKVDSPVELGKTFHAYTAPWADPEWSQQELQTFFEGVSVVPADARLKLVPGSHPGVEVKTILLSRKIEPRIEEAFPESEKLISMALGAWETGEISLELVPLGSLGPNIQALSCSMSGHLQIAICVGRGLDERIDVSANCQVIAETLLHAVAESMMRMPHEYAVLSESLVTAGVTETTARQLREEPDTPLVVRWSKKELLRQLCLGFEVDSHWEKLPENVRNMLLDRCLGRPCLLSEGSQQWLQTSLCRFDTSDLNVHVARCNLGAATAVSILDYANYGTGEAGAIKDPEIPIYIPEIPKKLPMAMSIIQKPLSYVYHSIGSGVKFFIAALLADSEFQREFDHVMSERHTLIRVPLVFLLNMVWLYFKTVQDIGLSFFLFHGRSNVKRLWNETKGITVSIKKSRFVVQSLEGTFTAFRHNEPDGGFKVYYYSGEHKTEPEGMKLLKYVSTYSKDMLLLIRQEFKDGKVLNEYHYDYRAPTKKSFTLSKAWATRIPLGRRCVRGQNNLQSVQYNRKGLIEAGSYMKDGNLIRFKYHYRKNPRFGDELLRAEFSLTHITCTVSWCAPPLRHPEKVERWIPHSKVTEATFVQGADVYEARWLYDHKFHPTIFTTLNGQKVQTPPMIENDFIGVLAKPKQTSFVNDNPLLYCDSLSSNTVTRFLGLTTKRFPVSTSRARSLLWKSWKDRVDFDAIMVRWLDERLLRREKTLAPYWRARNRGDLAAAKKYLELRADAITASADLDDNISSWTPLAVKISDLFNFGPGGDAVVHTRSKDFGSDTDKSMHVMAADNGTWPNEGGGVSACRRDMINSLRTVKWHMICESANDFGIPKHQTEQNVLSLKVVPLWGLDFLTPTHGLFRNKLDSEVDNVTSASDMDIKLNFIPILTALVKGARATHLSKADIHQATRALVNLNTYFQDSRHWTQIWNSDIVKESWRDLWLTQEMPNTVPSSQWFRTELPTLTSLDTALELWYRYLFIFSIPIPEKIPSVFQASHHSVSASYGVVCKMKRNCTLQIWDHAISWRETNLCLSSALCKLSPFVRNALLGLMRITSALTLHHADIILPCADFFNPGWEVEIGTCQGTIEHRNVFRRKVDPVVNGITDMQKFAPVKEIKSQRPTVTMLSHVWYAKDIKIALLAADIIINQWKFDDYHLDIYGAIDKAPTYSTECQEIIASKGLRGKVTLRGTADPMKVLENTWLFLNSSLSEGLPLALGEAALTGAPVVCTDVGASLRVLSDPDDFSRYSAVVAPNDAHALAKAQITMLGLLGEWSKYTDDTEPAPVLTSSPTPEDVAKITRRMYEKSDYRRKLGMMTRDIVQKSFSGDRYLREHEQMLWIGKSAKIMANRVGGAITEPTDIATAMRQTLPIEEEVITIPRSAVHSWRSSAASGMSTVYSEVSNFPMLNGYHRPSSIRSGISGMSTDTESFLPLPSNASLPVFAPRQTLGYPSTPDGRLSPSGRLSPLPNPRNSGRRSMSTAGREQLRGLGREELNPYRNSDVSTIMRDEFLQSSIYKNIEGSNSTPNMI

SEQ ID NO: 50 - DNA, 9060 bp, Aspergillus sojae
cggacctgtgaggttggcctgcaatatctaatcaggatggcggaaatcctccacgtctcagccctcggctgggataaaatgaaagatcattggtggcagtttgtaagtagtgattgcatatacgtttcaaatatcactgactaatgctatgctaggtgttcatcgctatcttaatagcttgtgtagctacaggatccttgtggctcctgtactctgggacgaagagactgcgcaactacatcaaggtagggcttctttgatatgcttgtgaatgtatatctgatctgtcgctcacctgattcaaatcatagacaaggccacgttcagagaaagtgccacccaatgtatctcaacggttggttactctttccaacaagttgctcagtgtgccaaacattcaaagacgcaagccgtcttcttttggcgtctatctgggttcattcagttccccgccagatcgggatcagcttcggctcctgaatgaatgggacctgttgatcgttgacccttttcagtcgggcacggcccaagcaatccgttatgtggagggtaagcagttattgggaagagttgaccttgatcgtatcctctcaaaggatgagtccacattgtcagcaattgaaaagattgaaaaccttctcaccggcacattcgatagtgctaacttcagcggtatggtactggccaactgggaaggaaagtttcccgccccggttttcactaagcttgttgaggtgatcgatgagctgggtttggcagtgtacctggagacggcacccccggactttctaaaggaccacacctccatgcaaaaccctgcaatttccggaatcgttattcaaaatgccagtatactgccagaaggccagaagcgcgactattttcaactcgtgaagatgcaacccaccatcaaggcgttcgtctctgaagcttgtgtgagagatttcgtggtgatggcgtgggagacaatcgatgacaatgcctcattatcgaatgctgttgtccaaagatctctccagtggtgtaacttttacagtgcgatcccatggattggtcagaagtcggctctcacaaatgccgcccttaatgtcaagatctcagagcctctctcctcttttggatggctgaaagatgccgaaatcatcaaagcccacgatcgctggcgctcaaatttacatctcaaggatgatgcatccgatacgagcgcttggaacacattgttgccgtttttccctaccctagaagaattgcttacctcgtcggaatatggtcagcctgagagcaacgagttgacgacaaaactccgcgatccaccggagtgggtagcacaggtaaaatctctagggagtccactttccatatcaatggccggcattgaatataactctcttggttgcttcccgcttggatctgaggcgacagcacttgcttttgccgaagtccttcagtctcaattgcgccttaaatcactgggcttgctccacccggttcctgcttccaagattcagagcatcggtctgctcctcaagaaatttcacgaatcttatttgcttcccaacgcaaccagctcagatccttacgtcattccaaacgcaacctcggaccaactggcgactacgatcaaggaactgtcgaacctggcaactaacggctcattgcaggtcaaccttggactggactcaggacttcgtaagagcgtcgacgtgcgcttttgggcagtttatcagatggactcggatggttttgaagtttttgcttcgaaaaaggcccaaggtttagcaggaactgtactgcatacattcttatctgcaaaaggatacccccgccacgtttgttttgaggtagaaaccgctttagccaaatggtctaaggacctcgtcaatgatacaggacttcctcgccgtttcgtcgaagacatcgacatgctgagcccagaagagcgactgcttctgtttcagcatctctccttgaccgactcctacagtgagctctccgatactatctgtgcatacattcggagactgcttatcgatgcgccttcactcgctcagctgaaggagcttaacacgatctcatatcttgaaggatcggcttctcccgaaattttggttaatacccgcatcaaatggtaccgagaacagggatgccaacatccgtcaccatccaaatgtctcgcattattctaccagacggatgccgcttttactcagatcctaagggagcatcgcgagggagaccttgctttgatatcaaagggcttctgccagctgcttcaaaatgatcacatcgatgcgtatactgatatcatggcattggcacttttctgcgctgcgaggaaaggagcaatcgatgagatttatactgaagtgaccgatcgtaacccgttgttcaacaatcaatcagaccaagcggctgctttctcagaatcgtttgctttagggtcacgttgtgaggtctactttgatgttcagcctagcgcttttggaaagctgctctcggatcgtttcagaagggagtacaacgatgagaagctccccgattggatcaatggcgcgcctgagatggccacatcttatgcgggtgcccaaattgacgttaacccggatgacaaggttaaaccgatgcctggctaccagcgatttactttcctcggtgttttcgcattcccagcattgatcgacatcattctgctcacaattatcggccgtggtctctacctttcagccttcatgacccatgacgagctacagagtgccaccatcgctttgatgatctcccttctcctatctggtgcaatcggtacgatgattgcctgtggaggaccctactatctcatttcgatggctttcgcagcttcaaacatgtttgtccttatccgactaattgctggtgttgcgtttacaattgctgctggtttaatcggattcatcgttatctctggcgtgaaaagcccacaggctggaattatcttctatctgtacctagtcgccttgaccatttacctgacgaccttcgctaccctcgctagctttagttaccctggaaccggtttcttgtccgggcgcaaagtgatcttcagctgcatccccattcttttcgtctcacctatcatcactacttggagcggccacgattcagctatttacctcgctgtgctatatgtcttcatcgggtttttgcttctcggcttgcgatcagttgcctctaaatgggtgacctggtatcagaacatcaggaggacggacgatacggaaatccggaaatggtatatttccacgtacggtaataacgacgagaaggtgtttggaaacatgagtgacccggctgtcttgaaaatgtcaagagatgctctctttaaggatgtcttggctgagaagtcccggagcttcttctctaagcccacaactgatacgctggtccgcgagcttgccagggactgggattcgacgaatttcctcctcgactggtactgccgttatgctgatgtgcctcggccgattccgttcagttcctcttggaatatccagaccaaggtcgggctagacgttcttcggaattcccagaaaggaatccggttgcataatgccttcatccattggcgccaatcgagcaaagaaataggctgtggaattctgtactttatcatagccctcctggacaaatgggttgagttattgagcggtggacaactcgttggtctctcaacctccctttctgatgccaatcggatggcagtcggatttggattggcttactacctcattggggccgttctcatcgataccaaggcccaggaactccatgatcttgtgggccagcattcggctgttgctgtgggatcagccaaggagatacgtccgtcccaaaagcgagacgtgagatttaagagaaaagtctactggaagacctttttcaaatttctcatgtggcttgtgtggagcttggctattgcaactgctttgatctggactttccaagcaccagtgcaagcgatgatcatgtttttcgcttatgtattgtcctataccggcctgctttggtaccaatatacaaagatcttcaccggcccgcacgccctcataccgctgatgactggtgttgtcgtcggattgcctgtcggtatcgccctcaaagtatgccttggcaataacttcttatactcccaggtgattggtctaggagcagctacatggacagtggctattctatcccttttcaccgccaagatgggcatgcccaagaaagttgactcacctgtggagcttgggaagacattccacgcatataccgctccgtgggcggatcctgagtggtcccaacaagagttacagacattctttgaaggagtctcagtcgtccctgccgatgcgcggttgaaactggtgcccggctcgcatcctggtgttgaagttaaaactattctactttcgcggaagatagaaccaagaatcgaagaggccttcccggagtcggaaaagcttatcagtatggccctgggtgcctgggaaacgggcgaaatatcccttgaacttgtgccactgggctcgcttggccccaacattcaggcgttgagctgcagtatgtctggtcatctgcagattgccatctgcgttggacgaggactagatgagcggattgatgtcagcgctaactgccaggtcattgccgagactctactccacgcggtcgccgaatcaatgatgcgaatgccccacgagtatgccgtgctttctgaatcgcttgttacagctggtgtgactgaaacgaccgccagacaactccgggaggaacctgacactccactcgtcgtacgctggtcaaaaaaggagcttctgcggcaactgtgtcttggatttgaggttgactctcattgggaaaaactgcctgagaatgttaggaacatgttgttggatcgttgtcttggtaggccatgtctactatccgagggcagtcaacaatggcttcaaacgagtctttgtcggtttgacacgagcgatttaaatgtgcacgttgctcgctgcaacctgggagctgccactgctgttagtatccttgattacgcgaattacggaaccggtgaagcaggggccatcaaggatccggaaatcccgatatatatcccagaaattccgaagaagcttcctatggctatgtccatcatccagaagccgttgagctatgtatatcactctattggctctggagtcaagttcttcatcgctgctttacttgccgattccgaattccagagggaatttgatcatgtcatgagtgagcgccacacattaattcgggtgccgcttgtgtttttgttgaacatggtttggctgtatttcaaaacggtgcaagatattggtttgtcatttttcttattccatggccggtccaacgtgaagcggctgtggaacgaaaccaagggcattaccgtcagcatcaaaaagagtcgctttgttgtgcagagcttggaaggtaccttcactgcttttaggcacaacgagcccgatggcggcttcaaggtgtactattactcgggagagcacaagacagagccagagggcatgaagcttctcaaatatgtcagcacatattcaaaggatatgcttctgctcattcgccaagagttcaaggacggcaaggtgctcaacgagtaccactatgactaccgcgctccaacaaagaaaagctttaccctatccaaggcgtgggcgaccagaatccccttgggtcggcgttgcgtacgcggacaaaacaacttgcaaagtgttcagtacaaccgcaaaggtctcatcgaagcgggctcctacatgaaggatggaaatcttattcgcttcaaatatcattaccgcaagaaccctcgcttcggtgatgagctgttgcgcgctgagttttcgttgacacatatcacttgcacagtttcctggtgcgcgcctccccttcgccatccggaaaaggttgagcgttggatccctcattctaaggtcaccgaagcgacgtttgtccaaggagctgatgtctacgaggctcgttggctgtacgatcacaagttccatcccacaattttcacgacgcttaatggacagaaggtgcagacacctccgatgatcgaaaacgacttcataggagtgctcgccaaacctaaacaaaccagctttgtgaacgataaccctcttctatactgcgacagcctcagctcgaacactgttacccgtttcctagggctaacaactaagcgcttccctgtatccacttctcgtgctcgttcattgctatggaagtcttggaaagaccgcgtagactttgatgcaattatggtccgttggttggatgagcggctcctgcgaagagaaaagaccctggctccctactggcgtgctcgtaatcgtggtgatctggcagcggcgaagaaatatcttgaactccgcgcggacgccatcaccgccagcgctgatttggatgacaacatctccagctggacccctcttgcggtgaagattagcgatctttttaacttcggacccggaggtgatgcggtggtccacaccagatcgaaggacttcggctctgatactgacaagtcgatgcatgtcatggctgctgataatggtacttggccgaacgaaggaggcggtgtctctgcctgtcgacgtgatatgattaactcgctaaggacagtcaagtggcatatgatttgcgaatcagcaaatgactttggtattcccaagcaccagacggagcaaaatgtcctttcgttgaaagtggttcctctttggggcttagacttcctcactccaacacatgggcttttcaggaacaaactcgactcggaagttgataatgttacatccgccagtgacatggatatcaagcttaacttcatcccaattctgactgctctggtgaagggagcgcgtgcgactcacctttcaaaggctgatatccaccaggcgacccgggctttggtcaacttgaacacatacttccaggactcgcggcattggactcagatctggaacagcgatattgtcaaagaaagctggagagacctttggcttactcaagagatgcctaataccgttccatcatcccagtggttccgcaccgaacttccaaccctaacgtcacttgatactgccttggaactttggtatcggtatctcttcattttctccattccaattcctgagaagatacccagcgtctttcaagcatcgcatcacagtgttagcgcgtcctacggggttgtatgcaagatgaagagaaactgcaccttgcagatttgggaccacgccattagttggcgtgaaacgaacctctgcctgtcgtccgccctgtgcaagctttctccattcgttcgcaatgctctcttaggtttaatgcgcatcacttcagctcttactttgcatcatgccgatatcattcttccttgcgctgatttcttcaatccaggctgggaggttgaaattggtacctgccaaggaaccattgaacatcgcaatgttttccgcaggaaggtcgaccccgttgtcaatggtatcactgacatgcaaaagttcgcccctgtgaaggagatcaagtctcagcgcccgacagtcaccatgttgtcgcacgtgtggtatgccaaggatatcaagatagctctgcttgccgccgacatcattatcaaccagtggaagtttgatgattatcacctggatatttatggggccatcgacaaggcgccaacatactctactgaatgtcaagaaatcatcgcctccaagggtctccgaggcaaggttactctccgtggtaccgcagatccgatgaaggtgctcgagaacacctggcttttcctcaattcgtcactttccgaaggtctgcccttagccctaggtgaagctgctttgaccggtgcccccgtggtttgtaccgatgtcggtgcatctcttcgtgttctgagcgacccagacgacttctctcgttacagtgccgtcgtcgcacccaatgacgctcacgccctcgcaaaagcgcagatcaccatgcttggccttctgggagaatggagcaagtatactgatgacactgagccggcacctgtgctcacttcatctccaacaccagaggacgttgccaagatcacccgccgcatgtatgagaagagcgattaccgccgcaaactcggcatgatgacccgcgatatcgtccagaaatcattcagtggcgaccgatacctccgtgagcacgagcagatgctgtggatcggcaagtctgccaagatcatggccaaccgtgttggaggagccatcactgagcccacagacatcgcaacagccatgcgccagactctcccgattgaagaagaagtcatcaccatccctcgcagcgccgtgcactcgtggcgttcgtctgctgcatcgggcatgtcgacagtatacagtgaggtttccaatttcccaatgctcaatggctaccaccgtccatcctctattcgctcaggtataagcggtatgtcaacggatacagagtctttccttcctctccccagcaacgcctccctccctgtcttcgcgcctcgtcagaccctgggctaccccagcacccctgacggtcgtctctcaccttcggggcgtctctcaccgctaccaaacccgaggaacagtggccgacgatccatgtcaaccgctggccgcgagcagctacgtggtctcggacgcgaagaattgaacccttaccgcaattccgacgtcagtaccatcatgagagacgaatttcttcaatcaagcatctacaagaatatagaaggcagcaacagcacccccaacatgatctaaaacgaaaaaggaaaagaaaaagaaaaatcccatctagttctcttggttttgcatctccttttttaattttaatttttcatttttttgcatactatatgactgatttttgggttatactcccggccctggcaataattgctaatctgtcattgtctataccaaccatataccccgagatgatgaagtgctcgttgtaaatacctgcatcttgcatatactttcccttattttgcatctaacttcatcatta

SEQ ID NO: 51 - protein, 428 aa, Aspergillus niger
MESPRQSDASTPVEPCSPGCVDTPATQSSVLFDGNLEELLRNFPLDQYILVTGGLGFIGSHTTLELLKAGYNVIVIDNLSNSFQSVFDRIRQLAAKYHDQEGTCMPSLQLHAHDFRDIAALRGLLEQYQIQSRWGTPKSRIGGVIHFAAYKAVEESIRNPLKYYANNVSGLIDFATTLGEFGIKTFIFSSSATVYGTLATSGLPLKEELCVHKEEVYSDQDGLEQTVKPGCTGITNPYGRTKWICEAILADLAASDPEWTIVALRYFNPIGCDESGLLGEDPRQTPTNLLPVVVKVMTGQYKELQMFGTDWDTEDGTAVRDFIHVTDLARGHIAALNAANGGKLVENFRTFNLGTGRGHSVMEVVNTMEAVSSKPIPRKAAGRRAGDVGSCVAVATRSQDELEWKTEKSLKDACVSLCNFLNVSGLSS

SEQ ID NO: 52 - DNA, 1483 bp, Aspergillus niger
gttgctcgttttgaggaaaatataagatttgggaaactcctttccttgggttatcccgtccagagtcaagtcacctgcggtcgttaaattctcgttggagaataaatctttctgtcctttccttgtttttgtttgtccaagtgattcctgtccgcattgccccccaacggtgcctcatccttcgaccctatcagttatggagagccctcgacagtccgatgcaagcactcctgtggagccttgctcccctggttgcgttgacacgccggcgacgcaatcttccgtgttgtttgatggcaaccttgaagagttgctgcgcaactttcccctcgatcagtacatcctcgtcacagggggtctcgggttcatcggcagtcacacaacattggagctactcaaagccggctataatgtaattgtgatcgacaatctcagcaactctttccagagcgtcttcgaccgcatcagacaactggccgcaaagtaccatgaccaggaggggacatgcatgccgtcattgcagctccacgcccatgatttccgggatattgctgctcttagaggccttcttgagcagtatcagatccaatccagatggggaactcccaagtccagaattggtggcgtcatccactttgctgcttataaggctgtggaagagagtatcaggaaccccttgaagtattacgcgaacaatgttagtggtcttatcgactttgccacaactttgggagaatttggaattaaaacattcattttctcctcctccgccacggtgtacggaaccttggcaacttcgggtcttcccttaaaggaagaactctgtgtccataaagaagaggtctacagtgaccaagacggtctggaacagaccgttaaacctggctgcacgggtattacgaacccgtatgggcgcaccaaatggatctgcgaagccatattagcggaccttgcggcttctgatccagaatggaccattgtagccctacgctatttcaaccctataggatgtgacgaatctggccttttgggagaggatcccaggcagacgcccacgaaccttctcccggttgtggtaaaagtcatgaccggacaatataaggagctgcagatgtttggcacggactgggacactgaggatggcactgcagttcgcgatttcatccatgtcaccgatcttgctaggggacatattgctgcgctcaacgccgccaacggtggaaagctggttgagaactttcgtaccttcaacctgggcaccggacggggtcactctgtgatggaggtggtcaacacaatggaagcagtgtcttccaaacctattcccagaaaagctgcaggtcgtcgcgctggagatgttggctcttgcgtcgctgtcgccacaagatcccaggacgagctcgaatggaagaccgaaaaatctctgaaggatgcttgcgtgagcctatgcaatttcctcaatgtcagcggcctgtcctcttag

SEQ ID NO: 53 - protein, 299 aa, Aspergillus niger
MGQGEHVRDRRCLQSRRSRLILAILVFIALLAVVIPPAVVLTLHKFTMGPKASVFVPLYVYPAPGAWDPLEKVISSHPDVNFTVVVNPGSGPGPNALPDGNYTREIPKLASYGNVRLLGYVATTYGQRNFSLVRRDIETYAAWPTNSSNPNLAVRGIFFDETPQQYESNTLAYLQDLTAVVKTTTGLGPDHFVVHNPGTIPDARYLPTADSTVVFEATYETFLERQGAKLFQEIPNSTRSQLCAVVHSVPDSVEGHKFRDLVKQVRKVADEIFITHLDTDYYASFGGQWEEFVELMARS

SEQ ID NO: 54 - DNA, 1400 bp, Aspergillus niger
atggggcagggtgaacacgtgagagaccggcgctgcctgcaaagccggcgctcgcgactcattctggcaatccttgtattcattgcccttctcgccgtcgtcataccaccagcagtagtgttgaccctacacaaattcaccatgggccctaaagcatcagttttcgtaccgctctacgtctaccctgccccgggagcatgggatcccttagaaaaggtgtaggtgcttttttccttttgttatccccttctccatatctcaacaagccctcgccaaatgttaacccccctcccccttccccttccccccgccaaccacattgtactccagtccatgcccacgctatctgtcagccaccggatgtcccgcggcacgatacaagtaaccctgatgtacgaaggacgcagctgaacgccacaggatctcttctcatcccgacgtcaatttcaccgtcgtggtcaatcctggtagtggtccagggcccaacgccttgcccgatggaaattacacacgagagatacccaagctggcgtcttatggcaacgtccgcctcctaggctatgttgctaccacgtacgggcagcgcaacttctcgttggtgcggcgggacattgagacctatgcggcgtggccgaccaacagttcgaaccccaatctagcggttcggggtatatttttcgacgaaaccccccagcaatacgaaagcaataccttggcctacctccaagatctgactgctgtcgtgaagacaaccaccggcctgggtccggaccattttgtacgtgcagaagtctctcccgtattttcattctttcattactaggggtaacgccgggtaatttacaccattaccaaatttcggcagctggcatttccgcccactcgctcattgccttttgctgccccctcaaacgcatggttctttttctctttgctttttttggatgcttctgttctggctcctgttcctgccgacaatcctcatccagagccgtcgtttggatcgcccggatagatctggatggacgcccaccattggcccgagtttaccatgctaacgagactgtctcaactaggtcgtccataatcccggcacgatccctgatgcccgctacttgccgacggctgattcgactgtggtctttgaggcaacctacgagacgttcttggagcgtcaaggggctaagctgtttcaggaaatcccgaacagcactcgcagccagctgtgcgccgtggtccactcggtgccagacagcgtggaagggcacaagttccgagacctggtgaagcaagtgcgcaaggtcgccgatgagattttcatcactcatctggatacagattattatgcgagttttggcggccaatgggaggaatttgtggaactaatggctcgatcgtga

SEQ ID NO: 55 - protein, 323 aa, Aspergillus niger
MEPASEAALKGPPSRGWKTWTFKKKLIIIGGIIGFIIALGIGLGVGLGVGLGGGGGGGEEEGGGGETTPPSSGNYTSAKWQPAVGTSWQIELLYPLNDTSVDVDVYDIDLFNNNKSVINDLQKAGRKVICYFSAGSYENWRPDKDKFNSDDLGKNLDGWPGEKWINISSPRIRKIMLTRLDLAQNKSCDGVDPDNVDGYDNDNGLDLTEADSISYMNWMANEAHARNMSIGLKNAGSIISSVIKNMQWSVNEQCSQYDECDTYAAFTEAGKPVFHIEYPKGDDTNNDLSVTSSQKSKACNFTDSGNFSTVIKNMDLDNWIEMC

SEQ ID NO: 56 - DNA, 1885 bp, Aspergillus niger
gcaacgccaagggttatacacacccccagcgccaagtcggcatagtcgagtcgacgagcttgtcctctatcccaggatcaccgtgtttcaagctgttcactagctccgaagccggaggttccatggttggaggtggagatggctctggtgtttcgagcatcgaacaaccgtggaagctcctgaagaaatcgcaatctctgggtccctattttgtggactgagcacggtcgcatcttagcgatctctgtttattttccgcttaactcttttggtaagcgacccaagactgagttagactggaaatcagtcactaagggcatccggccgaacccggtttgtccaccagtcgacgtgaagcatccaacgccaagttggtgaacggacaagacaccggcggcttggtggttttgattcttggccagttaggcccccgaattttcgcctctttgtcttccggcgtttcccctctcgtcgactacccattcaatttagggcagggttgcacagctaatgagcgtggcgggaacgatttgcagggtccagctggttcccttcagggtccgactctctcaccacctcaccacactgcctatcatcatcaccaacttgacgccccttcagtttcgctcatttggcaagctgtttcggacggcgtgctgcaatatgaaccgcagatccgtgtgaccagtgaagcttctttgacttcgtcttcaggcaacttcatttcctcaagctgcaatcgccgtggttttgacaggcaagtcccggtctagactcaactggtgactgtttctttgcattgcgctccaccttttattccccgtagccccggatcttcttgtttcgtcgcgaggtttgttcttttttcgcgattcctcctttgctctcactcgtgtgaaatctgttctacgcgatggagcctgccagtgaggccgccctcaagggccctccctcgcggggatggaagacatggacattcaagaagaagctcatcatcattggaggaatcatcgggtttatcatcgccctgggcatcggtcttggagtcggactgggtgttggactcggcggcggagggggaggaggagaggaagagggaggaggcggggagacgacgccacccagttcaggcaattacacctcagccaaatggcagcccgccgtcggcaccagttggcagatcgagttgctctatcctctgaatgacacctccgtcgacgtggatgtctacgacattgatctgttcaacaacaacaagtctgtaatcaacgatctgcaaaaagcaggccgtaaagtcatttgctacttctccgccggcagctacgagaactggcgcccggacaaggacaaattcaactcggatgatctgggtaaaaacctggacggatggcccggcgagaaatggatcaacatcagctctcctcgcattcgaaagatcatgctcacccgcctggacctggctcagaacaagagctgcgacggggtggacccggataacgtcgacggttacgacaatgataacgggctggatctgacagaggccgattcgatcagctacatgaactggatggccaatgaagcgcatgcgcgcaacatgtccatcggtctgaagaatgcgggttccatcatctcgtcggttatcaagaatatgcagtggagcgtcaacgagcaatgctcgcagtacgacgagtgcgatacctacgctgccttcacggaggcagggaagccagtcttccacatcgaataccccaagggtgacgacaccaacaatgacttgtcagtgacctcgagtcagaagtccaaggcgtgcaacttcaccgactcgggcaacttctccacggtgatcaagaacatggacctggacaattggatcgagatgtgctag

SEQ ID NO: 57 - protein, 804 aa, Aspergillus niger
MNSLKSSITSLNCFLGFITCTTPPGIWPKNPTVLTSASTASATSVAEVTRPTTPGTTSAVHSLTTTTTASLVSFLSSTSSAASTFVTSVGSPTTFVDTSASGSASALSSSTTTTMSVSLSLSSSIVASSAVPAATPVSSGSIAADILVIARDTASAGVASSGLNAYGIPFTTLIVPQSGTSLPALNGTEGGNFGGIVVASEVSYNYGNATGYQSALTTDQWNQLYAYQLAYGVRMVQYDVYPGPSYGASAAGDGCCATGVEQLMSFTDISDFPTSGLKTGAGVSTTGLWHYPATVTNTTTTKEIARFAANSDSGSETTAAVINNFNGREQMAFFISFDTTWSATSTYLQHAWIPWLTRGLYAGYRRVNLNTQIDDMFLETDIYKPNGTTFRITPADLDGIANWLPEINGKMNAGSNYYVEVGHNGNGNIEAAAGVSDEGYTTCNEGGIEYNSPADTPLEWKKPLGTGTNLWPSSPTTYDWSTACTQFDPLLLWWTNTTNQDKFGHISHTFTHEEQDNATYSDVYKEISFNQAWLKQVGISSAKHFTANGIIPPAITGLHNGDALRAWWENGITNCVGDNTRPALLNQQNDMWPYWTNEDSDGFAGMQVNPRFATRIYYNCDTPDCTLQEWIDTSAGSGDFDNLLATEKGEVMRHLFGLHHDPYMFHQANLRNADVTPITVNGVTAQYSIFQAWVETQVQEFVRLVDWPLVTINHEDMSASFLARYTRDACNYSLRYTISDHKITGATVSATDNTCNATIPVTFPVAPTNTQSFTTEQVGSDPLTVWVQLSGSPVSFTLSTPIAL

SEQ ID NO: 58 - DNA, 2655 bp, Aspergillus niger
atgaattccctcaaatcgtcgatcaccagtctcaactgctttctgggctttataacatgcaccacgcccccggggatttggcctaagaacccgacggttctaaccagcgcatctactgcctcagctacttctgtcgctgaagtcaccaggcccaccactcctggtactacttcagctgtccattcgttgactaccacgactactgcttctctcgtttccttcttgtccagtactagctctgccgcgtccacctttgtgacctcggtgggctctcctaccacattcgttgatacctctgccagtgggtctgccagcgccctaagcagcagcactaccaccactatgtctgtcagtctgagtctcagttcgagcattgtggcctcgtctgctgttccggcagcgacgcccgtcagcagcggctccattgccgccgacatcctggtgattgcacgcgacactgcctcggcaggcgtggcatcatccggtctcaatgcctatggcattcccttcaccactctgattgtgccccagtccggcaccagcctcccggccctgaacggcacggagggtggcaacttcggcggtattgtggttgccagcgaagtcagctacaactatggcaatgccacagggtaccagagtgccctaaccacggaccaatggaaccagctgtacgcctaccagctggcctacggggtgcgcatggtgcagtacgacgtgtatccgggcccgagttacggcgccagcgctgccggcgacggctgctgtgccaccggggtcgaacagttgatgtcgttcacggacatcagcgactttcccacgtcgggcctgaagaccggtgcgggcgtgagcaccactggcctctggcactatcctgccactgtcaccaacaccaccaccaccaaagaaatcgctcgttttgccgccaactccgactcgggcagcgagaccaccgctgccgtgatcaacaacttcaatggccgtgagcaaatggccttcttcatctccttcgatactacctggagcgccacctccacgtacctgcagcacgcatggattccctggctcacccgcggtctgtacgcgggttaccgccgcgtgaacctgaacacgcagatcgacgacatgttcctggaaaccgacatctacaagcccaatggcaccactttccgcatcaccccggccgacctggacggcattgctaactggctgccggaaattaacggcaagatgaacgccggcagcaactactacgtcgaagtcggccacaacggcaacggcaacattgaagccgccgccggggtctcggacgagggctacaccacctgcaacgagggcggcatcgagtacaactcgcccgccgacactcccctggaatggaagaagcctctgggaaccggcaccaacctctggccctcctctcccactacctacgactggagcaccgcctgcacacagttcgaccctctcctgctctggtggaccaacaccaccaaccaggacaagttcggtcacatctcccacaccttcacccacgaggagcaagacaatgccacctactctgatgtctacaaggaaatctccttcaaccaggcctggctgaaacaggttggcatctcctccgccaagcacttcactgccaacggcatcatccctcccgccatcacgggcctgcacaacggcgacgccctgcgcgcctggtgggaaaacggaatcaccaactgcgtgggtgataacacgcgccctgccctcctgaaccagcagaacgacatgtggccctactggaccaacgaagactccgacggtttcgccggtatgcaggtcaacccgcgtttcgccacccgcatctactacaactgcgataccccggactgcacgctgcaggagtggatcgacacgtccgctggctccggtgactttgacaacctgctcgctacggagaagggcgaggtcatgcgtcacttgttcggtctgcaccatgacccctacatgttccatcaggccaatctgcgtaatgcagatgtgacccccatcacggtcaacggcgtgacggcccagtactccatcttccaggcgtgggtggagacccaggtgcaggagtttgtgcgcttggttgattggccgcttgttaccatcaaccatgaagatgtacgccaatatagcccccctattaccactccaactgaacccacttattatgaatgctaataatatgaatagatgtccgcctccttcctggcccgctacacccgcgacgcctgcaactactccctgcgctacaccatctccgaccacaagatcacgggcgccacggtctccgcgacagataacacctgcaatgctaccatccccgttaccttccctgtggcgccgaccaacacgcagagcttcacgaccgagcaggtcggaagtgatccgttgacggtgtgggtgcagttgtcggggtcgccggtcagctttacgctgtcgacgccaattgcgctgtaagagagggggggagtttctagatgttcataaaatgtgtaatggatatattagatactagtcagtgactacgtgggtatgattatattgagtctgaatatattagttagttagtgagatgggatgaatacggctatgacataaatacaacaaaataactgggtattaagc

SEQ ID NO: 59 - protein, 2883 aa, Aspergillus niger
  misc_feature (1875)..(1890): Xaa can be any naturally occurring amino acid
MVEILDVSPVGWVFMKEFWWQYVLIAILLASVVCGCSYLTYSGTRRAIRWYKTRPRVEIVPAAVSQRLEKIANQQLTLAAAHHTKRKPTSVGVYLGTFATPLDETHRQLLDRYDLLIVDPSKSGVVHAILHTDGKQVLGRVDLALSSSQQDLTLAAIEQIDSALAGSFHGSAFSGIVLANWEDKFKPKVLAKLAEAIHGLGLAVYLETGPPTFLEDGQSLQTPAISGLVVRNASILPDGQKRDYFQLDKLRPTIKAFVSEACMRDFLVLAWETVDDDVTLSNAVVQRSMQWCNFYSAIPWIGRKAALENAAINVKTPEPLSSFSWLKDAETMKAHDRWRTNLDIARNYVAKASWDTLRAYFPSVDDLLFSSEHSPTIKNPPANKLREPPEWVAQVKSQGSPLSISMAGVEYKELGCFPLGSEATPVAFAEIVHSQQRLKSLNLLHPVPSSKLQNMGLLFRQFYENFALSSWMASDQLAASIKELSNMAANDTLRVHLGLDSGLRKSADVRFWAVYQMDADGFDVFASKNAQGLAGTVLHTFLSAKGYPRHVCFEAEIALARWSKDINEDIGLPRRIIQDIDALSPEERLLLLQHLSLTDAKGDLSETMCAYIRRQLVDAPTLAQLKELNTVAYLEGSASPELLIETRINWYKEQGCQYPSAASSLALFYEAESVFTKVLRERREDDLAQISSGLGQLVQDGPIDAYTDVLVLSLFCAARKGALDEIYAEVTDRNPLFNNQSDQAAAFAESFALGSRCEAYFDVSPSAFGKLLSDRFRKSYNDEKLPDWIHGAPDMATSYAGAQIDVDATHKVKPMRGYQRFTFLSVFAFPALIDIILLTIIGRGLYLSAFMTAEEQQSATIALMISLLLSGAIGTWIACGGPYYLISMAFAAANMFVLIRLIAGIAFTVAGGLIGFICISAAVSPRAGIIFYLYLIALTLYFSCFASLASFSYPGSTFLSGRKVIFACVPILFVSPIVTTFTGHDSAIYLAVIYAFIGLLLLGLRSVSSKWVTWYQSIRRTDDTEIRKWYVATYGNNDEKVFGNLSDPAVLKLSREALFKDVLAETKRWFYQKPTTDKLVLELAKDWEATNFLLDWYCRYADVPRPIPFSSSWNIQTKVGLEVLRNSQKGIRLHNAFIQWRQSSREIGCGVLYFLLALLDKWVELLTGGQMTGLAPSVTSSQRMAVGFGLAYYLIGAVLIDTKAQELHDLVGKQTTLAVPNAKDIRLAQKRDVKYKRMVYWRTLFKYLGWHVWSLALATALIWTFQDTMEAMIIFVAYILAYTGLLWYQYTKIFSGPHAFKTLLIGCVVGLPVGIALKTRLPHFLYSEVIGLGSATWTVAILTLFKAKMGMPKKVSSPVELGRVFHAYSSPWSDPEWSQQELQTFYEKLSLVPSDARLSLSPQAHPGVEVKEILLSRRKETRIEEAFPKSDDLVNLALGAWGKGEISLELVPVGSLGPGIHALSCCTSGQLHIAICVGRGLDQRIDVSANCQVIAETLLHAVAESMLHMPHEHAVLAESLVTAGVTETMARQLRAEPNTPVVIRWAKKELLQQLCLGFDCDSHWEKLPKDVRQALINRCLGQPCQLSEASRQWLEGRLCQFDADTLDVHVARSNLGAASAVSILDYAHYGTGEAATFNDPETPEHIPYVPKKLPSIIQMLAKPWNTIYYAFASVVKFIVVALVADPEFQREFDHVIGQHHAIIRVPATLALSLLWSYSRIMQNIGLSFFLFHGRDNVKQLWNEAKGMTISIQKSRFIIQSLDGTFTAFKHDETDGGFKIYYYSGQHKTEPEGTKSLSYVCVYSKDVLLMVRQEFKGGKLLNEYHYDYRAPTKKAFGLSKSSQARIPMGRRCVRGDNHLQSVQYNRKGLIEAGSYXXXXXXXXXXXXXXXXYRKNPRFGDELLRAEFALSHITCTVSWCAPPLRHPEKIDRWIPHSKVTEATFVQGADVYEARWLYDHKFHPTIFTTLNGQKVQTPPMMEHDYLGVLAKPKHTSFVHDNPLLYCDSLNSSIFSRFFGLTKKRFPVSTSRARSLIWKAWKERVDFDGVIVRWMDERLLRRDKTLAPYWRSRDRGDLASAKKYLDVRADTITASADLDDNISSWTPLAVKISDLFNFGPGGDAVVNTRSKDFGADTEKSLHVMAADNGTWPNEGGGVSACRRDMINSLRTIKWHMICESANDFGIPKHQTEQNILSLKVVPLWGLDFLTPTHGLFRNKLDSEVENVTSASEMDIKMNFIPILTALVKGARAIHLSKADIQQATRALVNLNTYFQDSRHWTQVWDSEIVKESWRDLWLSQEMPNTVPSSEWFRTELPTLASLDIALELWYRYLFIFSIPIPEKIPNVFQASHHSVSASYGVVCKVKRNCTLQIWDHAISWRETNLCLSSALCKLSPFVRNSLLGLMRVTSVLTLHHADIISPCADFFNPGWEVEIGTCQGTIEHRNVFRRKVDPVVNGITDMQKFAPVKEIKSQRPTVTMLSHVWYAKDIEIALLAADIIINQWKFDDYHLDIYGAIDKAPTYSTECQEIIASKGLRGKVTLRGTADPMKVLENTWLFLNSSLSEGLPLALGEAALTGAPVVCTDVGASLRVLSDPDDFSRFSAVVAPNDALALAKAQITMLGLLGEWSKYAEDDAPPPVLTSSPTPDDVAKITRRMYEKSEHRRKLGMMTRKIVQKSFSGDRYLREHEQMLWIGKSAKIMANRPHVNLQEPTDVATALQQTLPIDEEVITIPRSAVNSWRSSAASGMSTLYSSVSNFPMLPTGNQRPSSIRSSLSNTSTDASSFMRLPSSASLPVFAPRQTLSFSGGPGGDTHLSPGRLSPVVSRSGRHSRSQSISTAGREQLRGLQREDLHQYRNSDVSMIMREEFLQSSIFRGIEGGSGGSNIV

SEQ ID NO: 60 - DNA, 8837 bp, Aspergillus niger
  misc_feature (5755)..(5854): n is a, c, g, or t
atggtggaaatcctcgacgtctcacccgtcgggtgggtgttcatgaaagaattctggtggcaatatgtacgtgactgtgtgtcctgcctcggagaaacttgtctggtgttaacctgttctactttgttttaggttctgattgccatcttgctggcaagtgtggtctgtggatgttcatatcttacctactctggcacccgcagagctatacgatggtataaggtgggttcccaccccccaacatgtatatgctaattggaacccctttatctgatcttccctttcagacaagaccgcgtgtagaaattgtgccggctgctgtctctcaacgcctggaaaagatcgccaaccaacagcttaccctagccgcggcgcatcacacgaaacggaagcctacatccgtgggagtctacctaggcacttttgctactcctttggatgagacgcatcgtcagcttctcgatcgctacgacctcttgattgtggatccttccaagtccggggttgttcatgcaattttgcataccgacgggaagcaggttttgggccgagttgatctcgctctaagttcttcccagcaggacttgactctcgccgccatcgaacagatcgacagcgccctggctggaagctttcacggaagtgccttttctggtattgtgctggcgaattgggaggacaagttcaagcccaaggttctcgccaaattggccgaagccatccacggtctgggtctggctgtgtatctggagactggtccgcccactttcctggaggatggtcaatcgctacaaaccccggccatctctggtttagtcgtccgaaatgctagtatcctccccgacggtcagaagcgagactacttccagctcgacaagctgcgcccaaccatcaaagcctttgtgtcagaggcatgcatgagagactttttggttctggcctgggaaactgtcgacgacgatgttacgctttcgaatgctgtcgttcaacggtctatgcagtggtgtaatttctacagcgcaattccctggattggccgcaaggccgctctcgagaacgctgccatcaatgtcaagaccccggagccgctgtcctcctttagttggctgaaagatgcggagaccatgaaggcccacgatcgctggcgcaccaacctcgacatcgcacgcaattatgttgccaaggcctcttgggatacactgcgcgcatatttcccctctgtggacgacttgctcttttcttccgaacactcgccgacaatcaaaaacccaccagccaacaagcttcgcgagcctccggaatgggttgctcaagtcaagtcacagggcagtccgctgtccatctccatggcgggtgtcgaatacaaggaacttggttgtttcccgctcggctcagaggcaacacccgttgcttttgcagaaattgttcattcccagcagcgtctgaagtcactcaacctgcttcatccggttccgtcgtcgaaattgcagaacatggggctcctcttccgacagttttatgaaaatttcgccctctcgagctggatggcctcggaccaactggctgcctctatcaaggagttatcgaacatggcagctaacgatacgctgcgggtacacctcgggctggattctggtctgcgcaagagtgctgatgtccgcttctgggccgtgtatcagatggacgcggatggcttcgatgtcttcgcctctaagaatgcccagggactggctggcaccgtattgcacaccttcctctccgccaaaggctacccccgtcacgtttgtttcgaggcagaaattgcgttggcgagatggtcaaaagatatcaacgaggatatcgggttaccgcgtcgcatcatccaggacattgacgccttaagtccggaggaacgacttttgctgttgcagcatctgtcattgaccgatgccaagggcgacctttctgaaaccatgtgtgcgtacatccggcgacaacttgtggacgcgccaactctggctcagctgaaggagctcaacacggtcgcctacctggaggggtcggcttcgccagagctcttgatcgagactcggatcaactggtacaaggagcagggctgccaatatccttctgctgcctcgtctcttgcattgttctacgaggcggagtcggtcttcaccaaggtactgcgagagcggagagaggacgacctcgctcagatctcgagtggtctgggccagctcgtccaggatggtcctattgatgcctatactgacgtactggtcctgtcgttgttctgcgccgcacgaaagggtgccctcgacgagatctatgccgaggtaactgaccgcaatccgttgttcaacaaccagtccgaccaggccgcagctttcgccgaatcgtttgctctcggatcccgctgcgaagcctacttcgatgtttcgccaagtgcctttggaaagcttctgtcggatcgtttccgcaaaagctacaacgatgagaagcttcctgactggatccacggtgctccggacatggctacttcatatgccggtgcccagattgatgtcgatgccactcacaaggtcaagcccatgcgtggatatcagcgcttcactttcctcagtgtgttcgcttttcctgctctgattgatatcattcttctcacgatcatcggtcgcggactgtatctctctgccttcatgacggccgaagagcaacagagtgcgactattgcactcatgatttcgctcttgctctccggtgctattggcacctggattgcttgcggaggaccctattacctcatctccatggctttcgcagctgccaacatgtttgttctgatcagactgattgctggcatcgccttcacagtagctggtggtctcatcggtttcatctgcatttcggccgccgtgagcccgcgggccggaatcatcttctacctctacctcattgccctgacactctatttctcgtgtttcgcctcgctggcgagtttcagctaccctggctccacgttcctctccggccgcaaggtcatcttcgcatgtgtcccgatcttatttgtctcccccattgttaccactttcaccggtcatgactcggccatctaccttgctgtgatctatgcttttatcggattgctgctgcttggtctgagatcggtctcctccaaatgggtcacttggtaccagagcattcggagaacagatgataccgaaatccgaaagtggtacgttgccacttacggtaacaacgatgagaaggtctttggaaatttgagtgacccggccgtcctaaagctatcccgagaggcgttgttcaaggatgttctcgcggagactaaacgctggttctaccagaagcctaccaccgacaagttggtgctggagctagccaaggattgggaggcgaccaacttcctcctcgactggtactgcagatatgccgacgtacccaggccaattcctttcagttcttcctggaacatccagaccaaagttggactggaggtgctccggaactcgcaaaagggcatcaggctgcacaatgccttcatccagtggcgacagtccagcagagaaatcggatgcggtgtcctgtacttcttgctagccctgcttgacaagtgggtggagctactcaccggcggccaaatgacaggtcttgccccttcggttaccagttcgcagcggatggccgtcggatttggcctggcatactacctaatcggtgcggtcctcatcgacaccaaggctcaggagcttcatgatcttgttggaaagcagacaacgcttgccgtgcccaatgctaaagatatccgcttggcgcagaagcgggacgtgaaatacaagagaatggtatactggagaactctattcaagtatctcgggtggcacgtatggagtttggcccttgccaccgctctgatctggaccttccaggatacaatggaagcgatgatcatctttgtcgcttacattctggcatacaccggtctcctttggtaccagtacacgaagatcttctccggcccgcatgcattcaagaccctactcattgggtgtgtcgttggcttaccggttggcatcgctctcaagacccgcctgccgcacttcttgtattcggaagtcattggtctcgggtctgccacatggactgtcgctatcctcacactattcaaggcgaagatgggcatgccgaagaaggtctcatctccggtggagcttggaagggtattccacgcatactcgtctccctggtcagatccggaatggtcccaacaggagctgcaaacgttctacgagaagctctcgcttgttccgtccgacgcgcgcttgagcctgagtccccaagcccatcccggtgtggaagtcaaagagatcctactttcgcgcagaaaggaaacaagaattgaagaagcattccccaagtccgacgacctcgtgaacctggcgttaggcgcctggggcaaaggcgaaatctccctggagcttgttcccgttggctcactgggtcctggcattcatgcattgagttgttgtacgtcaggccaactgcacatcgccatctgtgtaggccgcggactagaccaacggattgacgtcagtgcgaactgccaggtcatcgcagagactctgcttcacgctgttgcagaatcgatgctgcatatgcctcatgaacatgctgtacttgccgagtcgctcgtcacggcaggtgtgacggaaaccatggcacgtcaacttcgcgcggagcctaatacaccggtcgtcatacgctgggccaagaaggagctccttcagcagctgtgcctcggattcgactgtgattctcactgggaaaagctgcccaaggacgtcagacaggctttgatcaaccggtgccttggccagccatgccagctctctgaggctagccggcaatggctggaaggaaggctttgccagttcgatgctgataccctcgatgtgcacgtcgcccgaagcaatctcggagctgctagtgctgtcagcattctggattacgcacactacggtactggtgaagcagccactttcaacgatcctgagactccagagcatattccatatgtcccgaagaagcttccttcgatcattcaaatgctggcaaagccctggaacaccatctactacgctttcgcttcagttgtcaagttcattgtggttgctctcgtcgccgatcccgaattccagcgagaattcgatcatgttatcgggcaacaccatgccattatccgcgtaccggctaccctggcattgagcttgctctggtcttattcaagaattatgcagaatatcggtctctccttctttttgttccatggtcgtgataatgtgaagcagctctggaatgaggccaagggaatgaccatcagcatccaaaagagcaggttcatcattcaaagtctggatggcacattcactgccttcaagcatgatgaaacggatggaggcttcaaaatctattactactccggccagcacaagacagagcctgaaggcacaaagagtctcagctacgtctgtgtttactccaaggatgtgctgcttatggtccgccaggagttcaagggtggaaagctgctcaacgagtaccattacgactaccgcgccccgaccaagaaggcctttggcttatccaagtcgtcccaagcaagaatcccaatgggccggcgttgtgtccgcggagacaaccatttgcagagtgtgcagtacaaccggaagggactcatcgaggcaggatcttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatcgcaagaacccccgttttggtgacgagttgcttcgagccgagtttgcactctcacacatcacttgtacggtctcatggtgcgctcctcctctgcgccatcccgagaagatagaccgttggatccctcactccaaggtcaccgaggcaactttcgttcagggcgccgatgtctacgaggcacgttggctctacgatcacaagttccatcccactatcttcaccacgctcaacggacaaaaggtgcagacgccccccatgatggaacacgactacctcggagtgctggccaagccgaaacacaccagctttgtgcatgacaatcctctcctgtactgtgatagtttgaactcaagcatcttcagccggttcttcggactcaccaagaagcgcttccccgtgtcaacgtctcgcgctcgctcgttgatctggaaggcctggaaggaacgtgtcgactttgatggtgtcatcgttcgctggatggatgaacgactcttgcgccgagataagaccctcgctccctactggcgtagtcgggatcgcggtgaccttgcttcggccaagaagtatctggatgtccgcgcagacaccatcacagccagtgcagatctggacgacaacatctctagctggaccccgcttgccgtgaagatcagtgatcttttcaactttggccctggtggtgatgcagtcgtcaacactagatccaaggactttggcgctgatacggagaagagcctgcatgtcatggctgctgacaatggtacctggccaaacgaaggaggtggcgtttctgcatgccgacgcgatatgatcaactccctgaggactatcaagtggcatatgatttgcgagtctgccaatgactttggcattcccaagcaccagaccgagcagaacattctttccttgaaggttgtccctctctggggtctcgacttcctcacgcccacgcacggtctcttcaggaacaagctggactcggaagtagagaatgtcacttccgccagtgagatggacatcaagatgaacttcatccccatcttgacggcactagtcaagggagctcgcgctatccatctgtccaaggcggatatccagcaagcgactcgagccttggtcaatctcaacacctacttccaagattcccggcactggacccaagtctgggacagtgagattgtcaaggaaagctggcgcgacctgtggctcagtcaagaaatgcccaacaccgtcccttcgtctgaatggttccgcacggaactccccacgctggcctctctcgacattgcactggaactctggtatcgctacctgttcatcttctcgattccaatccccgagaagatccccaatgtcttccaagcatcgcaccacagtgtcagtgcatcttacggtgtcgtctgcaaggtgaagagaaactgcacactccagatctgggaccatgccatcagttggcgtgagaccaacctctgcctgtcatccgcactttgcaagctctctcccttcgtccgcaactccctactcggcctcatgcgcgtcacctcggtcctaaccctgcaccacgccgatatcatctccccctgcgccgacttcttcaacccaggctgggaagtcgagatcggcacctgccagggcaccatcgagcaccgcaacgtcttccgccgcaaggtcgaccccgtcgtcaacggcatcacagacatgcagaagtttgcccccgtcaaagagatcaaatcccagcgcccaaccgtcaccatgttatcccacgtctggtacgccaaagacatcgaaatcgccctcctggccgcggacatcatcatcaaccagtggaagttcgacgactaccaccttgacatctacggagccatcgacaaagcccctacctactccacggaatgtcaagaaatcatcgcctccaagggcctccgcggcaaagtcaccctccgcggcaccgccgaccccatgaaagtcctcgagaacacctggctcttcctcaactcttccctctccgaaggtctccccctcgccctcggcgaagccgccctaaccggcgcccccgtcgtctgcaccgacgtcggcgcctccctccgcgtcctcagcgacccagatgacttctcccgcttcagcgccgtcgtcgcccccaacgacgccctcgccctcgcaaaggcccaaatcaccatgctcggcctcctcggcgaatggagcaagtacgccgaagacgacgctccaccaccagtgcttacctcctccccgacccccgacgacgtcgccaagatcacccgtcgcatgtacgagaagagcgagcaccgtcgcaaactgggaatgatgacccgcaagatcgtccagaaatccttcagcggtgatcgctacctccgtgaacatgagcaaatgctctggatcggcaaatccgctaagatcatggccaaccgtccgcacgtcaacctccaagagcccacggacgtcgccacggcgctgcagcagaccctccccatcgacgaagaagtcatcactatcccccgcagcgcggtcaactcctggcgctcgtccgctgcatcaggcatgtccactctctacagctccgtctcgaactttccgatgctgcccaccggcaatcaacgtccttcgtctatccggtccagtctaagtaatacctccacggacgcgagctccttcatgcgcctccccagcagcgcttccctccctgtctttgcaccccggcagacactgtctttctccggtggaccaggcggagatactcatctttcccctggtcgtttgtcgccggtggtgagccgctccggacgtcattcgcgctctcagtctatttctaccgctggaagagagcagctgcgtggtctgcaacgtgaggatctgcatcagtatcgcaactcagatgtcagcatgattatgagagaggagtttctgcaatcgagcattttcaggggcattgaaggtggcagtggtggtagcaacatcgtctga

SEQ ID NO: 61 - protein, 428 aa, Aspergillus fumigatus
MDSYQQSDASTPVEPCSPGCVDTPATQSSVLFDGHLDDLLRHFPLDQYILVTGGLGFIGSHTTLELLKANYNVIVIDNLSNSFQIVFDRIKLLASQYHERQGTKMPSLHLHAHDYRDTAALKELLEQHQTQTRWGTTKSKISGVIHFAAYKAVEESIRNPLKYYANNVSGLIDFATTLGDYGIKTFIFSSSATVYGTLATSGLPLKEELCTHKEEIYTDHDGSERIVQPGCTGITNPYGRTKWICEAILADLAASDPEWTIVALRYFNPIGCDESGLLGEDPRQTPTNLLPVVVKVMTGEYRELQMFGTDWNTEDGTAVRDFIHVTDLARGHIAALSAANEGKLAENFRTFNLGTGRGHSVKEVVETMEEVSSKHIPRRAADRRAGDVGSCVAVATRSQQELNWKTEKSLKDACVSLCNFLEVSGLST

SEQ ID NO: 62 - DNA, 1287 bp, Aspergillus fumigatus
atggacagctaccagcaatccgacgcaagcactccggtggagccttgctccccaggctgcgtggacacgcccgcaacgcaatcgtccgtcttgtttgatggtcatctggacgatctcctgcgccacttccctctcgaccagtacatccttgtcacgggcggcctcggcttcattggcagtcacacaacattggaactgctcaaggccaattataatgtgattgtgatcgacaatctcagcaactcctttcagatcgtcttcgaccgcatcaagctgttagcctcccagtaccatgagcggcaggggaccaagatgccgtcgctgcacctgcatgcacacgactatcgtgacactgctgctctcaaggaacttctagaacagcaccagacccagacccgatggggtacgaccaagtccaagatctctggtgtcattcacttcgctgcctacaaggcagtggaggagagcatccgcaacccactcaagtactatgccaacaacgtcagcggcctcatcgactttgccacgaccctgggtgactatggcatcaagacttttatcttctcctcgtcggccacagtgtacggcaccttggcaacctccggtctccccctgaaggaagagctgtgcacgcacaaggaggagatctataccgaccacgacgggagtgaacgcattgtccagcccggctgtacaggcatcaccaacccctatggccgtaccaaatggatctgcgaggccatcctggcggacctcgccgcctccgacccagaatggactatcgtcgctctgcggtacttcaaccccatcggatgtgacgagtccggcctcctcggagaagaccccagacagactcccacaaacttacttcctgtcgtcgtcaaagtcatgacaggcgagtaccgggagttgcagatgttcggaactgactggaatactgaggacgggacggccgtccgggacttcatccacgtcaccgaccttgcgcgcggccacatcgcggctctcagcgcagccaacgaaggcaaactggccgagaacttccgcacgttcaacctgggaaccggtcgcggacactccgtcaaggaagtagtcgagaccatggaggaagtttcctccaagcacatcccccgaagggcggctgatcgccgcgcgggggatgtgggctcctgcgtcgccgtggccacgcgatcgcagcaggagctcaactggaagacggaaaagtcactcaaggatgcttgtgtgagcttgtgcaatttcctggaagtcagtgggttatctacttag

SEQ ID NO: 63 - protein, 298 aa, Aspergillus fumigatus
MAEKHVSNRRCLQSRRSRILLAVFVLIAILAVVIPPAVVVTLHKKNDMGPKSKVFVPLYVYPAPGAWTPLEDVISKHPDVNFTVVINPGSGPGPNALPDGNYTREIPKLASYENVRLLGYVATTYAKRNISLVRRDIETYAAWPTNSSNPALAVRGIFFDETPQQYDEDALAYLQELTDVVKNTPGLGPDHYVVHNPGAIPDSRYLSTADSTVVFEATYDTFQERHGAKLFEAIPDSNRSQLCAVIHSVPESVEGSALRSLVKQVRKVADEIFITHLDTDYYASFGRQWPEFVDLMGK

SEQ ID NO: 64 - DNA, 1201 bp, Aspergillus fumigatus
atggcggaaaaacacgtgagcaatcgacggtgcctgcaaagccggcgctctcgaatcctcttggccgtctttgttcttattgctattctggctgtcgtgatccctccggcggttgtggtgacgctgcacaagaagaacgacatggggcctaaatccaaggtctttgtgcctctctatgtgtaccctgcacccggagcctggactccgcttgaagatgtgtatgttttccgcccacgttcaccttgaccttggtcatcttgggctagctgaatcatttagtcagcattgaggacaacagctgacgccacacccacatatacacacacacaggatctccaaacacccagacgtgaactttaccgttgtgatcaacccagggagcggacctggacccaacgcactgccggatggcaactacacgcgtgagattcccaagctggcttcgtacgagaatgtgcggctgctaggctatgtggcgacaacctacgcgaagcgcaatatctcgctggtgcgccgggacatcgagacgtatgcagcgtggccaacgaactcttccaacccggctctagctgttcgggggatctttttcgacgagacccctcagcagtatgatgaggatgccttggcgtatctgcaggagttgaccgacgttgtgaaaaatacccctggtttggggccggatcattacgtacgtttccctggtaattcattatcatatttggtaatttttatttccatttttatttattttttttatttgtttggttttgtttcctcgcttgccaccttcccagtgtatatatcactttgtttttttttttttttttcagtcaagctgtcgtctacagtttgcaagtgctaaaatgctcactaattacaggtggttcacaatcccggcgcgatccctgactctcgctacctgtcgactgcagactcgactgtcgtgttcgaagcaacgtacgacacctttcaggaacgccatggagccaagctgttcgaggcgatcccggacagcaaccgcagccagctctgtgcggtgatccactccgtccccgagagtgtcgaagggtctgcgctccggagtttggtgaagcaggtccgcaaggttgccgatgagatcttcatcacccacttggatacggattactatgccagttttgggcggcagtggccggagtttgtggatttgatgggaaaatag

SEQ ID NO: 65 - protein, 318 aa, Aspergillus fumigatus
MDSLGKGQSAGGWKSWTTRKKLFVLALVLLVIIALGVGLGVGLGIGLGGGGGGEGEEGSGGETTPPEGNYTTAKWQPAVGTKWQIELLYALNDTSVDAEIYDIDLFINDKSTIAGLQRAGRKVICYFSAGSYENWRPDKDKFKDSDLGHDLDDWPGEKWLNISSANVRQIMLDRLDMARDKGCDGVDPDNVDGYDNDNGLDLTQADSISFVNFLANAAHARNMSIGLKNAGDIIPSVIKNMQWSVNEQCAQYNECDTYAVFPQNGKPVFHIEYPKGDKTNNDLSVTASQKNAACDFAGSANFSTVIKNMNLNNWVEYC

SEQ ID NO: 66 - DNA, 957 bp, Aspergillus fumigatus
atggattcccttggaaaaggccagtcggccggcggctggaaatcatggaccaccaggaagaagctcttcgtcctcgcgctcgttctcctcgtcatcatcgccctgggagtcggtctcggagttggactcggcatcggtctgggcggcggcggcggcggcgaaggtgaagaaggctcaggcggggagaccacaccgccagaaggcaactacaccacggccaagtggcagccagcggtgggaaccaaatggcagatcgagctgctttacgcgttgaacgacacctccgtcgacgctgagatctacgacatcgacctgttcatcaacgacaagtccaccatcgcaggactccaacgagccggccgcaaggtgatctgctacttctcggcaggcagctacgagaactggcgaccggacaaggacaagttcaaggactcggatctgggccacgacctggacgactggccgggagagaaatggctgaacatcagctcggcaaacgtacgccagatcatgctggaccggttggacatggcgcgcgacaagggctgcgacggggtggacccggacaacgtcgacgggtacgacaatgacaacgggctggacctgacgcaggcggactcgatcagctttgtgaacttcctggcgaatgcggcgcatgcgcggaacatgtcgattggcctgaagaacgcgggggacatcatcccgtcggtgatcaaaaacatgcagtggagtgtcaacgagcagtgtgcgcagtacaacgagtgcgacacctacgcggtgtttccgcagaatggcaagccggtgtttcacatcgagtatcccaagggggataagaccaacaatgatctgtccgtcacggccagtcagaagaacgcggcgtgcgactttgccggctcggcgaatttctccactgtcattaagaatatgaatctgaacaattgggtggaatattgttag

SEQ ID NO: 67 - protein, 801 aa, Aspergillus fumigatus
MVFAWVIQAGCFFGFIKWVWTPHPTVVTSVPPSQASVSSSSVTSTVGLTTSSAVLSLTATPVTPTGTTLVSSVSSSSSSSSSSSSSSSSSSSSSSSSSSSSAAAAASSSIGLSSTMSLSLSSSAIPSVTPSATPVSHGSVLSNILVIAKDSSAASSATSGLNAYGIPYTTLLVPQAGVGLPALNSSNVGNYGGIVVAAEVSYDYGGTTGYQSALTTDQWNQLYAYQLEYGVRMVQFDVYPGPKFGASAVNGGCCNTGVEQLLSFTDTSDFPTAGLKTGATVSTEGLWHYPATISNSSNTKEIAQFAPNAVTSTASTAAVINNFDGREQMAFFIGFATDWSATSNYLQHAWITWLTRGLYAGHRRVNLNTQIDDMFLVTDIYYPNGSTFRITVEDMNGISAWVPTINAKMNPGSSYFVEVGHNGNGNIEQSSSTDAGAAACNGGGIEYDSPPDTPLEFKKPLGTGTDLWPSTPTTYDWTVACTQLDDLLRWWTTPANRDAFGHISHTFTHEEQNNATYADVFKEISFNQAWLKQVGLDQAKWFTSNGIIPPAITGLHNGDALQAWWDNGIRNCVGDNTRPVLMNQQNAMWPYFTTVESDGFAGMQVNPRWATRIYYNCDTPACTVQEWIDTSAGAGSFDDLLAVEKADTMRHLLGLRHDGYMFHQANLRNADVTPITVNGVTAKYSIFQAWVETIVQEFVRLVDWPLVTITHQEMSENFLARYQRDQCGYGLSYAVADKKITAVTVTATGNTCSRPIPVTFPVAPTSTQGYATEQLGSDPLTVWVQLSGSPVTFTLSTPIAL

SEQ ID NO: 68 - DNA, 2490 bp, Aspergillus fumigatus
atggtcttcgcgtgggtgattcaggccggttgcttctttggctttataaaatgtacgactcccccaggggtctggactccacatcccaccgtcgttacatctgtgcctccatcccaggccagtgtatcgagcagtagtgtaacatctactgttgggctgacgacctcgtctgctgtactctcgttaaccgccaccccggtgactcccaccggaaccactctcgtttcgtctgtttcttcttcttcttcttcttcttcttcttcttcttcttcttcttcttcttcttcttcttcttcttcttcttcttcttcttcttctgctgctgctgctgcgtcttcctcgattggcctgtcctccaccatgtctctcagcctcagttcgagcgccatcccctcggtgaccccctcggcgactcccgtcagccacggctcggtcttgtccaacatcctggtgatcgccaaggactcgtcggcggccagttcggcgacctcggggctcaatgcgtacggcatcccgtacaccaccttgctggtcccccaggcgggtgtgggcctcccggctctcaactccagcaatgtcggcaactacggcgggattgtcgtggcggccgaggtcagctacgactacgggggcacgaccggctaccagagcgccttgaccaccgaccagtggaaccagctgtatgcctaccagctcgagtacggcgtgcgcatggtgcagttcgacgtctaccccggccccaagtttggcgccagtgcggtcaacggcggttgctgcaacaccggcgtggagcagctgctctcgttcaccgacaccagtgacttccccacggccggcttgaagacgggcgcgacggtcagcaccgagggcctctggcactacccggccacgatcagcaactcgagcaacaccaaggagatcgcccagttcgctcccaacgcggtcacctcgaccgcgagcactgcggcggtcatcaacaactttgacggccgcgagcagatggcgttcttcattggctttgccaccgactggagcgcgacctccaactacctgcagcacgcctggatcacctggctcacccgcgggctgtacgcgggccaccgccgcgtcaacctgaacacgcagatcgacgacatgttcctcgtcaccgacatctactacccgaacggatccaccttccgcatcaccgtcgaggacatgaacggcatctcggcctgggtcccgaccatcaacgccaagatgaaccccggcagctcgtactttgtcgaggtgggccacaacggcaacggcaacatcgagcagtcgtcttccaccgacgcgggggcggccgcctgcaacgggggcggcatcgaatacgactcgcccccggacactcccctggaattcaagaagcccctgggcacggggaccgacctctggccctcgacgccgacgacctacgactggacggtcgcctgcacccagctcgatgacttgctgcggtggtggaccacgccggccaaccgcgacgcgttcggccacatctcgcacaccttcacccacgaggagcagaacaacgcgacctacgcggacgtcttcaaggagatttccttcaaccaggcctggttgaagcaggtcggcttggaccaggccaagtggttcacctccaatggcatcatccccccggccatcaccggtctgcacaacggcgatgcgctgcaggcctggtgggacaatggcatccgcaactgcgtgggcgacaacacccgcccggtgctgatgaaccagcagaacgccatgtggccgtatttcaccacggtggagtcggacgggttcgccggcatgcaggtcaacccccgctgggccacgcgcatctactacaactgcgacacgccggcctgcaccgtgcaggagtggatcgacacctccgccggcgccggcagcttcgacgacctgctggccgtggagaaggccgacaccatgcgccatctcctcggcctgcggcatgacgggtacatgttccaccaggccaacctgcgcaacgcggacgtgaccccgatcacggtcaacggcgtgacggccaagtactcgattttccaggcgtgggttgagacgattgtgcaggaattcgtccgcctggtcgactggccgttggtcaccatcacccaccaagaggtatgtccctatcctttttcttacgatgtctacctgtacaaactacagcctggctaacaactctggtagatgtccgagaacttccttgcgcggtaccagcgcgaccagtgtggctacggcctgtcgtacgccgtcgccgacaagaaaatcaccgccgtgacggtgacggccacgggcaacacctgcagccgtccgatcccagtgaccttcccggtggctcccaccagcacgcagggctatgccaccgagcagctgggaagtgatcccttgacggtgtgggtgcagctgtcgggatcgcctgtgacctttacgctttccactcctattgctttgtag

SEQ ID NO: 69 - protein, 3014 aa, Aspergillus fumigatus
MDQPGDAARMHGPAVHPLCQARRKRKLLLSALNRALLRGLLSLTRLVRDGMAATLLTPSFWSSRIAGFSRLFLVRVHACQPDVFSAVVTPRRFHPLGQKHTLLLSAILAQTGQTDRQQRSYFCLHQRALPRQTVLIGLLLGSVVIGCSYLLYAGLSRARKWYQVGIRSMSSVDALEEIADILQSRAQSAVVPRNVLDRLDRLSRQQLSLPNVQWAKKPSSFGVYLGSFDASPTRDQSRLLSQWDLLIVDPAQSGVVEALSRAERKQFLGRVDVGSGSGSTLAAIDRIESALSRFDGAPFSGMLLANWESSFNPAAIRKLAEALHAFGLPVYLETAPPDFLQDHKTLQTDAIAGLVIRNASIMPDGEKRDYFQMIKMQPTIKAFVSEACMRDFVVMAWETVDDNAHLSNAVIQRSLQWCNFYSAITWIGRQAALHDASLNVKIPEPLSAFSWLKEAEIMKVHDIWRANLNLQEEEVGPRDAWTALLQYFPTLSNVLTSSEREPPSHMDSATIAVRDPPEWVAQVRSQGSPLSISMAGVEYKEFGCFPLGSEATAVAFVEILKSQQRLKSLGLLHPVPSDKIQKLGALLRRFHDKFAVSHWPDLPTLPATIKDLANFASQDSLRINLGLDSGLRKSADVRFWAVYQSDADGFEVFASKSAQGLAGTVLHTFLSARGFPRHVCFEAETALAQWSKDVNEDIGLPRRLIQDVDALSPEERLLLLQHLSLTDAKSELSETICRYIRRQLIDAPSLAQLKELNTVAYLDGSLPPEALIKSRIHWYRDQGCRSPAPAACLALFQETDAVFTRILRERRESDLAQITNALCQLVQKDRIDVYADILTLSLFCAARKGAFDEIYMEVTDRNPLFNDQSDQAAAFAESFALGSRCEAYFDLSPSAFGKLLSGRFRRYYQDRELPDWINGAPQMATSYAGAQIDVNPDDKVKPMRGYQRFTFLSVFAVPALIDILLLTLYGRGLYLSGHMPEEVMHSASIALMISLLLSGAAGTWIACGGSYYLISMAFAATNMFVFIRLIACFAFTIAVGLVGFIVMSAVKGPGPGIVFYLYLIALTLYFSIFASLACFSYPGSKFLSGRKAIFACIPVLFISPIVTNWSHHDVVIYLIVLYIFIGLLLLSLRSVASKWVTWYQNIRRTDDTEIRKWYVSKYGNNDEKCFGGRSDPAVLKLSREALYRDVMAEVSRGFFSKPTTDQLVLELARDWEATNFLLDWYCRYADVPRPIPFSSGWNIQTKVGLDVLRNSQKGQRLHNAFMHWRQSSREIGCGVLYFVLALLDKWADLLTGGRMTGFLQMPNGDTRFAVGFGLAYYLIGAVLIDTKAQELHDLIGGQTNQAVGTSKEIRPSQKRAVRFKRKVYWRTFVKYLMWQVWSLALSTALLWTFRSSVDAMAMFCAYVLSYTGLLWYQYTKIFAGPHALRPLLAGIVVGLPVGIVLKTCVSGNFSNYGPVIGLGTATWTTAILTLLTAKMGMPKKVDSPVDLGKTFHAYTTPWADPEWSQQELQTFFERISLVPSDTRLKLEPGAHPGMEVKSLLLSRREEPRIEEAFPKASELIHRALQAWAQGEISIELVPLGSLGPGIRALSCHAADQLKLVLAVGRGLDQRIDVSGNCQVIAETLLHAVSESMLRMPHEYAVLAESLVTAGVTETMARQLREEPNTPVVVRWAKKELLRELCLGFECDTHWEKLPKTIRKALLDRCVGKPSHFSERDRQWLQEHLCRFDTSDLDVHVARCNLGAATAVSILDYAHYGTGEEALGKDSETPLFIPYVSKKLPAALAFVKDPLHNFWYSVASAIKFIIIALIADPEFQREFDHVMKQRARIIRVPCVFLLNLIWSYSKIVQDVILSFFLFHGRDNVKRLWDETKGMTISIKKSRFMLQSLDGTFTAFKHDDEDGGFKVYYYSGEHKTEPEGTKSLKYVSTYSKDMLLLIRQEFKDGKAINEFHYDYRAPNKKSLRLTRGSDTRIPLGRRCIRGDSHLQSVQYNRKGLIEAGSYMKDGNLIRFKYHYRKNPRFGDELLRAEFVLSHITCTVSWCAPPVRHPEKVERWIPHSKVTEATFVQGADVYEARWLYDHKFHPTIFTTLNGQKIQTPPMIEHDFLGVLAKPKYTSFVHDNPLFYCDSLSSNAITRFLGLSTKRFPVSTSRARSLVWKAWKDRVDFDGIIVRWMDERLLRRDKTLAPYWRSRDRGDLASAKKYLDLRADTVMASADLDDNISSWTPMAIKVSDLLNFGPGGDAVVNTRSKDFGSDTDKSLHVMAADTGTWPNEGGGVSACRRDMINSLRTIKWHMICESANDFGIPKHQTEQNVLSLKMIPLWGLDFLTPTHGLFKNKLDSEVENVTSANDMDIKMNFIPILTALVKGARAIELSKADIHQATRALVNLNTYFQDSRHWTQVWNSDIVKESWRDLWLTQEMPNTIPSAQWFHTELPTLGTLDVALELWYRYLFIFSIPIPEQIPSVFQASHHSVSASYGVVCKIKRNCTLQIWDHAISWRETNLCLSSALCKLSPFVRNALLGLMRITSVITLHHADIISPCADFFNPGWEVEIGTCQGTIEHRNIFRRKVDPVVNGITDMQKFAPVKEIKSQRPTVTMLSHVWYAKDIKTALLAADIIINQWKFDDYHLDIYGAIDKAPTYSTECQEIIASKGLRGRVTLRGSADPMKVLENTWLFLNSSLSEGLPLALGEAALTGAPVVCTDVGASLRVLSDPDDFSRFSAVVAPNDALALARAQITMLALLGEWAQYADDTEPAPVLTSSPTPDDVAKITRRMYEKAEHRRKLGMMTRNIVQKSFSGDRYLREHEQMLWIGKAVKTMAVRAAAGAPGTALGDPIDIADALQVADPIEEEVITIPQSAVHSWRSSAASGMSTVYSTISGYPMLPLTRPASIRSSFSNFSTATDSDSFMGLPSNASLPVFAPRQTLSFDAGGAVTPTGRLSPSGRLSPAFGRHRHSHARSISTLGREQLRGLQREEPHPYRNSDVSLHMREEFLQSSIFKSIDGNAGGKS

SEQ ID NO: 70 - DNA, 9776 bp, Aspergillus fumigatus
atggaccaaccaggagatgcagccaggatgcatggtcctgctgtacatccactctgccaagctcggaggaaacgaaagctgctgctgtctgctctcaaccgggcactcctccgtggactgctttccttaacgaggcttgtccgcgatggaatggctgccacgctgttgacaccgtcgttctggtccagcaggatagcaggattcagtagactcttcttagtccgggtgcatgcctgtcaaccagacgtattctcggctgtagtgactccaaggcggtttcatccgttgggccagaaacacacacttcttcttagcgccatcttagcgcagacaggacagacagacagacaacaacgaagctatttttgtcttcatcagcgtgctctgccgagacagacggtccatgaactaagcagttgctggttggtcgagaaatttcaactgatggattgcgcaaaacccaataaagcccgtcctattacttgctgcgaactagattctccgagggcccttatgatctcccctcgccactgggttttttttgagtcggagccgctaacggttggccatcaccgaccgctttttttgcttttatgaaggcaaacgtcaagttgtagtctataggctggtagatgtacatgctgggtttgctgtgtgtgtgacatctggcgtgccagctctttgacctgcgtgttggcctggtcgatcgatcgtccgtcctatcgtttcttttgccctcgttcgtccgtccgttcgtttgtttctaatctatctctcgatcgatttcgctatactccgctcgtttatgcaagaattcgcctccggggtcgatccatccgtgactggtgatggtcttttagagcgattgtctctctgttggtgtacatttttgggctctccgagtcgcctgcctggtctctcgcttttcgaccttcctcgtttccatgtccgtctctactcctaacttctagtctctaatcataccatcatgggttttatcgtcgcgactaccgacgatgatgatgattttcagaggcctcgtcccgtcggatgggcgcatatgacagattcctggtggcaatttgtatggagtctctcctcaagcctcgtgctttactaaccgagtataggtcctcatcggcttgctgctaggtagcgtagtgattggatgttcatacctcctctacgcaggtctgtcgagagctcgcaaatggtaccaggtaggtatccggtcgatgtcctcggtcgatgccctcgaggagattgctgacattttacagtcgcgggcccaatccgcagtggtgcccagaaatgtcttggataggctggaccgactatcaaggcagcagctgtccttgcccaatgtccagtgggccaagaagccgtcgtcgttcggcgtctacttgggctctttcgacgcatccccaaccagggatcagtcgagactcctgagtcaatgggatctgctgatcgttgaccccgcgcagtccggtgtggtcgaggccctctcgcgggccgagaggaagcagtttctgggccgagtagacgtcggttcgggctcagggtcgactctggcggctatcgaccgaatcgagagcgcactcagcaggttcgatggcgcgccgttcagcggcatgctcctggccaactgggagagcagcttcaacccggccgccatcaggaaactggccgaggctctccatgcctttggcctgcccgtgtatctggagacagcgcccccggacttcctccaggaccataagactctgcagaccgatgccatcgccggtctcgtcatccgcaatgcctccatcatgcctgacggcgagaaacgcgactactttcagatgatcaagatgcagcccaccatcaaagcgttcgtgtcggaagcctgcatgcgcgacttcgtggtcatggcctgggagacggtcgacgacaacgctcacctgtccaatgcggtcatccagcgatctctgcagtggtgcaacttctacagcgccatcacctggatcggccgccaggcggccttgcacgatgcctctctcaacgtcaagattcccgagcccttgtcggcctttagttggctgaaggaagccgagatcatgaaagtccacgacatctggcgcgccaatctgaacctccaggaggaggaggtcgggcccagagacgcatggaccgctctgctgcagtactttcccacgctttccaacgtgctcacctcgtccgaaagagagcccccctcgcacatggacagcgcgacgatcgcggttcgtgatccgccggaatgggtggcccaggtcaggtcgcagggcagcccgctgtccatctccatggccggcgtggaatacaaggagttcggctgtttccccctgggatccgaagccaccgccgtggcctttgtcgagatcctcaagtcccaacagcggctgaagtctctgggactgctgcacccggttccctcggacaaaatccagaagctgggcgccctcctgcgacgattccacgataaattcgccgtgtcgcactggcccgacttgcccacgctgccggcgacgatcaaggacctcgccaattttgcctcccaggattccctgcgcatcaatctgggcctcgactccggtctgcgcaagagcgccgacgtccgcttctgggccgtctaccagtccgacgcggacggattcgaagtgtttgcctcgaaaagcgcgcaaggcctcgcgggcaccgtgctgcacacgttcctctccgcgcgaggtttcccccgtcatgtctgcttcgaagccgagacggctctggcgcaatggtccaaggacgtgaacgaagacatcggactgccccgccggctcatccaagatgtggacgccctgagtcccgaggagcgattgctcctgctgcagcatctttcgttgacggacgccaagagtgaactgtccgagacgatctgccggtacatccgccggcagctcatcgatgccccgtccctggcgcagctcaaggagctcaacaccgtcgcgtacctcgacggatccctcccgccagaggccctgatcaagtcccgcatccactggtaccgcgatcaggggtgccgttctcctgcccctgccgcgtgcctggccctgttccaggaaacggacgctgtcttcacgcgcatcctccgagaacgccgcgagagcgatctggctcagatcaccaacgccctgtgccagctggtccagaaagaccggatcgacgtctatgccgatatcctcacgctctccctcttctgcgccgcccgcaaaggcgcctttgacgagatctacatggaagtcacggatcgcaaccccctgttcaacgaccagtccgatcaagcggccgccttcgccgagtcgtttgcgcttgggtcgcgctgcgaagcctacttcgacctctcgcccagcgccttcgggaagttgctctcgggtcgattcagacgatactaccaggaccgggaactgccggactggatcaacggcgctccgcagatggcgacctcgtatgccggggcacagatcgatgtcaacccggacgacaaggtcaagcccatgcgggggtaccagcgcttcaccttcctcagtgtctttgcggtgcccgccctgatcgacattctgctgctgacgctgtatggccgcggcttgtacctctccggccacatgcccgaggaggtcatgcacagtgcgtccatcgcgctgatgatctctctgctcctgtcgggtgcggcgggcacctggatcgcctgcggcgggtcctactacctgatctccatggcgtttgccgccaccaacatgtttgtctttatccgactcatcgcctgtttcgccttcacgatcgccgtggggctggtgggattcatcgtcatgtcggccgtcaaaggccccgggcccggcatcgtcttctacctctacctgattgccctgaccctctacttcagcatcttcgcctcgctcgcctgtttcagctacccgggctccaagttcctctcgggccgcaaggccatcttcgcctgcatccccgtcctgttcatctcgccgatcgtgaccaactggagccatcacgatgtggtcatctacctcattgtgctctacatcttcatcggactgctgctgctcagcctgcggtccgtcgcctccaaatgggttacctggtaccagaacatccgacgcaccgacgacaccgagatccgcaaatggtatgtgtccaagtacggcaacaacgacgagaagtgcttcggtggccggagcgatcccgccgtgctgaagctgtcgcgagaagcgctgtatcgggacgtgatggccgaagtgtcccgcggcttcttctccaagccgaccacagaccagctggtcctggaactggcccgggactgggaagcgaccaatttccttctcgactggtactgccggtatgccgacgtgccccggcccatccccttcagctcgggctggaatatccagaccaaggtcgggcttgatgtgctgcgcaattcgcaaaagggccaacgcttgcacaatgcgttcatgcattggcgccagtccagccgggagatcggctgcggggtgctctactttgtcttggctctgctcgataaatgggccgacttgctgaccgggggccggatgactgggtttctacagatgcccaatggcgacacgcgttttgcggttgggttcggcctcgcgtattacctgatcggcgccgtgctcatcgacaccaaggctcaggaactccatgatctcatcgggggccagaccaatcaggcggtgggcacgtccaaggagattcggccgtcgcagaagcgcgccgtgaggttcaagagaaaggtgtactggaggacgttcgtcaagtatctcatgtggcaggtctggagtcttgccttgtccacggccttgctctggacgttccggtcgtccgtggatgccatggccatgttctgcgcctacgtgctgtcgtacaccggcctgctgtggtatcaatacacgaagatcttcgctggtccgcatgccctccgaccattgctggccgggatcgtcgttggcctgcccgtcgggatcgtcctcaagacctgtgtgtcgggcaatttcagcaattacggcccggtgattggactgggcaccgccacctggacgaccgcgatcctcactctgctcacggcgaaaatgggaatgccgaagaaggtggactcgcccgtcgacctgggcaagacgttccacgcgtacacgaccccgtgggcggatcccgaatggtcccagcaggagctgcaaaccttcttcgagagaatctctctggtgccgtccgacacgcgactcaagctggagccgggtgcgcatccggggatggaagtcaagtcgctgctgctctcgcgccgcgaagaaccgcgaatcgaggaggctttccccaaggcatccgagctgattcaccgagccctgcaagcctgggcccagggggagatttcgatcgagctcgttcccttgggctcgctgggtcccggcatccgcgctcttagctgccatgccgcggaccagctgaaactggtcctggcggtcggacgcggactggaccagcgcatcgacgtgagcggcaactgccaagtcatcgccgagactctgcttcatgcggtgtccgagtccatgctgcggatgcctcacgagtacgccgtgctcgcggaatcgctcgtcacggccggcgtgaccgagaccatggcccggcagcttcgcgaagaacccaacaccccggtagtcgtgcggtgggccaagaaggagctcctccgggagctgtgtctggggttcgaatgtgacacgcattgggagaagctgcccaagacgatccggaaggcgttgctggaccgttgtgtcggcaagccgtcgcacttctcggagcgcgaccggcaatggcttcaggagcacctctgccgctttgataccagtgatctggatgtccatgttgcccgatgcaacctgggcgccgccaccgcagtcagcattctggattacgcccactacggcaccggcgaagaggccttgggcaaggactccgagacgccgctgttcattccctatgtgtccaaaaagctgcccgcggcgctcgcgttcgtcaaggatcccctgcacaacttctggtactcggtggcgtccgccatcaagttcatcatcatcgccttgattgccgatccggaattccagcgagaattcgaccatgtgatgaaacagcgcgcccgcatcatccgcgtgccgtgtgtgttcctcctcaacctgatctggtcgtactcgaagatcgtgcaggatgtgatcctgtcgttcttcctcttccatggccgggacaacgtcaagcgtctctgggacgagaccaagggcatgaccatcagcatcaagaagagccgattcatgctgcagagcctcgacggcacctttacggcgttcaagcacgacgacgaggacggcggcttcaaggtctactactacagcggcgagcacaagaccgagcccgagggcaccaagtcgctcaagtacgtcagcacgtactccaaggacatgctgctgctcatccggcaggagttcaaagacggcaaggccatcaacgagttccactatgactaccgcgcgccgaacaagaagagcctccggttgacccgcggctccgatacccgcatccccctgggccggcggtgcatccgcggcgacagccatctgcagagcgtccagtataaccgcaagggtctcatcgaggccggttcctacatgaaagatggcaacctgatccggttcaagtaccactaccggaagaacccccggttcggcgacgaactgcttcgcgccgagtttgtgctctcgcacattacctgcaccgtctcctggtgtgcgcctcccgtgcggcatcccgagaaggtcgagcgctggatcccgcactccaaggtcaccgaggcgaccttcgtgcaaggcgccgacgtctacgaggctcgctggctgtacgaccacaagttccacccgaccatcttcaccacgctcaacgggcagaagatccagacgccgcccatgatcgagcatgacttcctcggcgtcctggccaagcccaagtacaccagctttgtgcatgacaatccgctcttctactgcgacagtctcagctccaacgccatcacccgcttcctgggcctctccaccaagcggtttcccgtctcgacctcgcgggcccgctcgctggtctggaaggcgtggaaggaccgcgtcgactttgacggcatcatcgtccgctggatggacgagcggctgctgcgccgcgacaagacgctggccccgtactggcgcagccgggaccggggcgatctggcctcggcgaagaagtacctggacctgcgcgcggacacggtcatggcgagtgccgacctcgacgacaacatctccagctggacgcccatggcgatcaaagtcagcgatctgctgaactttgggcccggcggcgatgccgtcgtcaacacccggtccaaggatttcgggtcggacacggacaagtcgctgcacgtcatggcggccgacacgggcacctggccgaacgagggcggtggtgtgtcggcctgtcgacgcgacatgatcaactccctgcggacgatcaagtggcacatgatctgcgagtcggccaacgactttggcattcccaagcatcagacggagcagaacgtgctctcgttgaagatgatcccgctgtgggggctggactttttgacgccgacgcatgggctcttcaagaacaagctggactcggaggtggagaacgtcacgtcggccaacgacatggacatcaagatgaacttcatcccgatcctgacagcgctggtgaaaggcgcgcgcgccatcgagctgtccaaggccgatatccaccaggccacgcgggcgctggtcaacctcaacacgtacttccaggactcgcggcactggacgcaggtctggaatagcgacatcgtcaaggagagctggcgcgacctctggctcacgcaggagatgcccaacacgatcccgtcggcgcagtggttccacaccgagctccccaccctggggacgctcgacgtggcgctggagctctggtaccgctacctgttcatcttctcgatccccatccccgagcagatccccagcgtgttccaggcgtcgcatcacagcgtcagcgcctcgtacggggtcgtctgcaagatcaagcggaactgcaccctgcagatctgggaccacgccatcagctggcgcgaaaccaacctctgcctctcctcggccctgtgcaagctctcgccgtttgtccgcaacgccctcctgggcctgatgcgcatcacctccgtcatcaccctccaccatgccgacatcatctcgccgtgtgccgacttcttcaatcccggctgggaggtggagatcggcacctgccagggcaccatcgagcaccgcaacatcttccgccgcaaggtcgaccccgtcgtcaacggcatcacggacatgcaaaagttcgcccccgtcaaggagatcaagtcgcagcggcccaccgtcaccatgctgtcgcacgtctggtacgccaaggacatcaagaccgccctgctggccgccgacatcatcatcaaccagtggaagttcgacgactaccatctcgacatctacggcgccatcgacaaggccccgacctactccaccgagtgccaggagatcatcgcctccaagggcctccgcggccgcgtcaccctccgcggcagcgccgaccccatgaaggtcctcgaaaacacctggctcttcctcaactcctccctctccgaagggctcccgctcgccctcggcgaagccgccctcaccggcgcgcccgtcgtctgcaccgacgtcggtgcctccctgcgcgtcctcagcgacccggacgacttctcccgcttcagcgcggtcgtcgcccccaacgacgccctcgcgctcgcccgcgcccagatcaccatgctcgccctcctcggcgaatgggcccagtacgccgacgacaccgagcccgcccccgtcctcacctcctcgcccaccccggacgacgtcgccaagatcacccgccgcatgtacgagaaggccgagcaccgccgcaaactcggcatgatgacccgcaacatcgtccagaagtccttctccggcgaccgctacctgcgcgaacacgagcagatgctctggatcggcaaggccgtcaagaccatggccgtccgcgccgccgccggcgcccccggcaccgccctcggggaccccatcgacatcgccgacgccctccaggtcgcagaccccatcgaggaagaagtcatcaccatcccgcagtccgccgtgcactcctggcgctcgtccgccgcctcgggcatgtccaccgtctactccaccatctccgggtaccccatgctcccgctgacccggcccgcgtccatccgctcctccttcagtaacttctccaccgcgaccgactcggactccttcatgggcctgccgagcaacgcatccctgcctgtcttcgcgccgcggcagaccctctcattcgatgcgggcggggccgtgacgcccacgggtcggctgtccccgtcaggcaggctgtcgccggcgtttgggcggcaccgacactcgcacgcgcggtccatctccacgctgggccgcgagcagctgcgtggtttgcagcgtgaggagcctcatccgtaccgcaactcggatgtcagtctgcatatgcgcgaggagttcctgcagtcgagtatcttcaagtctatcgacggtaatgcgggggggaaatcctga

SEQ ID NO: 71 - protein, 2428 aa, Penicillium chrysogenum
MKWSLASGLVSLLVTTVTAWPYDEAYLDYNINTNKTATNPADYWGTWPGHEGKYFPSPDNWRFPFYSMFLDRFVNGDPTNDNANGTTFEHDIEHRIRHGGDVAGLVDTLDYLQGMGIKGIYITGTSLLNMPWTSDGYGVVDTTLLDAHFGTIQAWRDAITEIHKRGMYVLFDNTIATMADLIGFEGHLNKSTPFSEKEWPALWKSERRYRDFDIKEGHYNASCDYPRFWYEDGYPVNESQTAGLVGCYDSDFDQYGDIEAFGVWPDWKRQLAKFASVQDRLREWNPSVRERLIRHSCMIIHSFDIDGFRYDKATQATVDALGDMSAAYRECAREVGKENFFITGEITGGNDFGTIYLGRGRQRNQYPENSAVTMNLTNTSSAQYFLREAGHEAIDSAAFHYSTYRALTRFLGMDGQLTAGFDAPVDWVEGWDYMVKTNDLINANTGVFDPRHMFGATNQDVFRWPAIANGTHRQLLGTFVGTLLLPGIPLLLWGEEQNFYILDASAENYIYGRQAMSPATAWMTHGCFQLDSSQYYKWPITAGREGCHDITVSYDHRDPSHPVRNVMRHMFQMREHYPVLNDGYSLGSLTKQTEWVHYPGSNETATETGMWSVYRDVNAVLQEDLALNPDSIPVWLVYTNLNDTMTYNFDCKSKNPNKTLTAPFDAGTTVKNLFYPYDEITLVEGAQKLGLNGSKEMNGCTESMEMKAYEFRAYVPKNKHKSARPMITKFTPGHDFPLRSTVAPDLPEDVTVELYFSEEMNCDLVTDAITFNSSTEKGQVPTIDPKTVNCTTIPPLLQSNWTAEIPSVWKWTANLTGVYNGVHKLTVNNATNTDKSDSTNAIDHFLFRVGQFDNPMVFITANYSSSLLHRRENGDLFIQHHAAGADKYRYSTNWGSSFSDWRDYKGGNDTIDKLPWSGTKDQEWDGEHVRVEYWSRLTGSSDYVQQGDLDWNHPVTRRFPHAFFNGPYNQYGYDAGLDNRIRLDTRTGVWSYHFTSEWPAVGQLNIWGINPDGKPDQTWVLGDIDNDTILDRSPPSSLSATVINITAAPAKGYLSHKLYFDDGTLHFWLDPVGPQSTQIVMFILFWIIPFITAVGCVYIFMKSFYKVKFNEVGVTEKQNIPLAIWNKIKPSRRDQSSNPLMRLANKSGFMQSTSALGGALASGKRRMVLIATMEYDIEDWAIKIKIGGLGVMAQLMGKTLGHQDLIWVVPCVGGVDYPVDQVAEPMTVTILGSPYQVQVQYHVLNNITYVLLDAPVFRQQSKTEPYPARMDDLDSAVYYSAWNQCIAEAIKRFPIDTYHINDYHGSLAPLYLLPRTIPACLSLHNAEFQGLWPMRTIKEKQEVCSVFNLEEDIVRRYVQFGEVFNLLHAGASYLRVHQAGFGAVGVSKKYGKRSYARYPIFWGLHKVGNLPNPDPSDVGEWTKEPTKEEDITVDPTYEAGRGELKRQAQEWAGLDQNPDADLLVFVGRWSMQKGVDLIADALPAVIEARPNVQLICIGPVIDLYGKFAALKLDHMMKVYPGRVFSKPEFTALPPFIFSGAEFALIPSRDEPFGLVAVEFGRKGALGIGARVGGLGQMPGWWYNVESVSTSHLLIQFKLAIEAALNSKTSVRAMMRARSAKQRFPVAQWVEDLEILQNTAIQVHIKEASKTHSTNSTRPGTSSGFSTASAAMSPSMNQLGSPLPSPGINSPFTHSRESSYSFNQMNSLGTQKKVSYSADPDQEETEKPKSGLSRSLSLGVRSGPGHAGRRRRAAEGGIPESDENGATDVDENSDEEAAHNAFDDDEYTLTPAQVEAGRRAQAAQRDRAQNLPSPSRRPSQDSLQPRFMVPLESPRSPGTPPAVDSLLLPPQPFAESNRLSSASVLSLDSVVGNKTDYKLQKVDPFFTDQTGEYYRIFDKKLDVLNGSNSESQLCIEEFLIKSEQEWFDRFRNARLGRNKSPTPSIRHSSRNTATPDTMFYNDDLASNVNSDEDNHLQDDEFLLGKDYVPPTGLKKWMQVKIGDWPIYSMFLALGQIIAANSYQITLLTGEVGQTAEKLYGIATTYAIASMCWWLVYRYFKSVVCLSTPWFLYATAFLLIGSAHWEGDSFTRGWIQNVGTGFYAAASASGSIFFASNFGDEGGAPVKTWIFRACVIQGIQQAYVIALWYWGSTMTKASSEGLLNPETNIANSWKMSAICYPICIFLCIVGVLLAMGLPNYYRQKPGKVPSFYKSLFRRKIVTWNFIAVILQNFFLSAPYGRNWSFLWTSIHTHAWQIVILCIVFFGFVWCIFLFVVSRFSKRHSWFLPVFACGLGAPRFIQIWWAVSGIGYYLPWAGGYTSGALVSRSLWLWLGVLDSIQGLGFGIILLQTLTRVHMCFALIASQVIGSIATICARAFGPNNVGPGPISPDMTQGAHSLANGWFWVALFCQLLVCAGFLLFFRKEQLAKP

SEQ ID NO: 72 - DNA, 7571 bp, Penicillium chrysogenum
atgaagtggtcactcgctagcgggctggtctcacttcttgtgacgaccgtcacagcttggccctacgatgaggcctacctggattataacataaacacaaataagacggccaccaacccggcagattactggggaacatggcctggtcacgaggggaaatatttcccctccccggataactggcgcttcccgttctattctatgttcttggatcgcttcgtgaatggtgaccctaccaatgacaatgcaaacggtaccaccttcgagcatgatattgaacatcgcattcgccatggtggcgatgtggctggtcttgttgacacactggattatctccaaggaatgggaatcaaggtttgtctcatccgaattgtctaatggcaagaaaatatatgctcacaatgtccagggtatctatatcacgggaacctccttgctgaacatgccgtggacttcagacggatatggagttgtggatacaacgcttcttgacgcccattttggcacaattcaagcttggcgagacgccatcaccgaaatacacaagcgcgggatgtacgtcttgttcgacaataccattgcgacgtaagttgtctctgtatgcatagtgaatagagcagagctaacctaattgtatagaatggctgacttgattgggtttgaaggccatctcaacaaatccaccccattctcggagaaggaatggccagcactatggaagagtgaacgccgatacagagacttcgacattaaagaaggtcactacaatgcgagctgtgactaccctcgattctggtacgaagacggataccccgtgaatgaatcgcagaccgcaggtttggttggatgttatgacagcgacttcgaccagtatggtgatattgaggctttcggtgtttggcccgattggaagcgacaactggcaaagttcgcctccgtccaggatcgtctacgtgaatggaacccgagtgtgcgcgaaaggttgatccgacactcctgtatgatcattcattctttcgacatcgatggtttccgctatgataaggccacccaagctactgtggatgcccttggggacatgtccgctgcctacagagaatgcgcgcgcgaggtcgggaaggaaaacttctttatcactggcgaaatcacgggtggaaatgactttggtactatttacctcggaaggggtaggcagaggaaccaataccctgagaactcggccgtcacaatgaacttgacaaacacgtcctctgcccagtacttcttacgcgaagcgggccatgaagccattgatagtgcggccttccactactcgacctatcgtgcattgactcgattcctcggcatggacggacaactcacggcaggctttgacgcgcctgttgactgggttgagggctgggactacatggtgaaaacaaatgacttgatcaatgccaataccggcgtgttcgaccctcgacacatgtttggtgcgactaatcaagacgtcttccgctggccagcgattgcgaacggcacccatcgacagttactcggtacttttgtgggtacattgctgctccccggaatcccgcttctcctttggggagaagagcagaatttctatatcttggatgccagcgcggagaactacatttacgggcgacaggctatgtcgcctgcaactgcgtggatgacccatggctgcttccaattggactcctcccagtactacaagtggcccatcacggccggtagagagggctgtcatgacataacagtttcttacgaccaccgcgacccctcccaccctgtccgaaatgttatgaggcatatgttccagatgcgcgagcactacccagttctcaatgacgggtactcccttggcagcttgacaaagcaaaccgagtgggttcactaccctggttccaatgaaacggccacggagaccggaatgtggtctgtttaccgggatgtcaacgccgtcctgcaagaagatttggccttgaatcctgacagcattccagtctggcttgtttacacaaacctcaatgacacaatgacatacaacttcgactgcaagtccaagaatccgaacaagacactgacagcgccatttgatgctggcaccactgtcaagaaccttttctacccgtacgatgaaatcacactggtagaaggagctcaaaagcttggcttgaatggatcgaaggagatgaatggctgtacggaaagcatggagatgaaggcatacgagttccgcgcatacgtccctaaaaataagcacaagtcagctcggcccatgatcaccaaattcactccgggccatgatttcccactacgctctaccgtggcgcccgaccttcccgaggatgtgacagttgaactttacttctcggaagaaatgaactgtgacttggtgactgatgcaattaccttcaattcatcgacagaaaaggggcaggtcccaaccatagaccccaagactgttaattgcacaaccatccctcccttgctccaatcaaattggactgctgagataccaagcgtttggaagtggacagcaaacctgactggagtttataacggagttcacaagttgactgtcaacaacgcaaccaacaccgacaaaagcgattctaccaacgctattgatcacttcctcttccgtgtcggtcagttcgataaccctatggtattcatcactgccaactactcgagcagtctactccacagaagagaaaatggcgacctttttatccagcaccacgccgctggtgcagacaaataccgctattctaccaactggggatcgtcattctctgactggagagactacaaaggtggaaatgatactattgacaagctcccatggtcgggaaccaaggatcaggagtgggatggtgagcatgtacgtgtcgaatactggagtcgcttgaccggaagcagcgattacgtgcagcaaggtgaccttgactggaatcacccagtcacacgacgcttcccccatgctttcttcaacggaccgtataatcaatatggatacgatgcgggcctagataacagaatccggctcgacacgagaaccggggtctggtcctaccatttcacctccgaatggcctgcagtcggacagctcaacatctggggaattaatccagacgggaagcccgatcaaacttgggttttgggagatatcgacaatgacacaatcctggaccgaagtcctccgtcttctctgagcgcgactgtgatcaatatcactgcagcgccggctaaaggctacctctcccacaagctatacttcgacgatggaactctccatttctggcttgatccggttggaccccagtccacacagattgtcatgttcattctattctggatcataccattcatcactgccgtgggatgtgtgtatatcttcatgaagtcattctacaaggtcaagttcaacgaggtcggtgtgactgagaaacaaaacatccccctcgcaatttggaacaagataaagccctcccgtagggatcaatcctcgaacccactcatgcgcttggccaacaaatctggcttcatgcaaagcaccagtgccctaggcggggcccttgcatctggcaagcgccgcatggttctaatcgccactatggagtacgacattgaggattgggctatcaaaatcaagatcggtggtctcggtgtcatggctcaactcatgggtaagaccctaggtcaccaagacctaatctgggtcgttccatgcgttggaggtgtcgactaccctgtggaccaggtcgcggagcctatgacagtcactattctaggcagcccctaccaggttcaagtgcagtaccacgtcttgaataatatcacctatgtactgctcgatgctccagtgttccgtcaacagtcgaagaccgaaccgtaccctgctcgcatggatgatctcgacagtgcagtgtactattcggcatggaaccagtgtatcgctgaagctatcaagcgattcccaattgacacctaccacatcaacgactaccacggttctctcgcgcctctttacttgctaccaagaaccatccccgcctgtctttcattgcacaatgctgagttccagggtctctggcctatgcgcaccatcaaagaaaaacaggaggtttgctcggtctttaaccttgaagaagatatcgttcgtcgttacgtgcaatttggtgaagtgttcaacttgctccacgccggtgcaagctatctccgtgtgcaccaggcaggattcggtgccgttggtgtttctaagaagtacggcaaacggtcttacgctcgctatcctatcttctggggtttgcataaggttggcaatctacctaaccctgatccatctgacgtcggtgaatggacaaaggagcccaccaaagaggaagacatcactgtggatccaacttacgaggctggccgtggtgagcttaagagacaggcccaggaatgggcagggctcgaccagaatcctgatgccgacctgcttgtgttcgttggtcgctggtctatgcaaaagggtgttgatcttattgcagacgcactgcctgctgttatcgaagctcgacctaacgtgcagttgatctgtattggtcccgtcatcgatctctacggtaaattcgctgctctcaagcttgaccacatgatgaaagtctatcccggacgagttttctcaaagcctgagttcactgcacttccgccctttatcttttctggtgccgagttcgccttgatcccgtcccgtgacgagcccttcggtctggttgccgtagagtttggccgaaagggtgcattgggtatcggagctcgtgttggtggtcttggccaaatgccaggctggtggtacaatgtggaatcagtctcgacgtcgcatctcctcattcaattcaagcttgcaattgaggctgccctcaactctaagacatccgtccgtgccatgatgcgtgccagatctgccaaacagcgtttccctgttgctcaatgggttgaggatcttgagatcctgcaaaatactgccatccaggttcacatcaaagaagcgtcgaagacacatagtaccaacagcactcgacctggcacttcttctggattcagcactgccagtgcggccatgtcaccttccatgaaccaactaggtagcccactgccttcacccggcataaactctccattcacgcattccagagaaagcagctactccttcaaccaaatgaacagccttggcacccagaagaaggtcagctacagcgcagatccagaccaggaagaaacggagaaaccaaagtccggactgagtcgttccctttccctgggtgtccgctcaggccccggtcatgctggacgtcgcagaagagcagcagagggtggtatcccagagagcgatgaaaatggagccactgatgtcgacgagaacagcgatgaggaagctgctcacaacgcgtttgacgatgacgaatacactctcaccccagcccaggtcgaggcaggacgacgtgcccaggctgcgcaaagggaccgcgctcaaaacttgccttcgccaagcagacgccccagtcaagattctttacaacccaggttcatggttcctttggaaagcccgaggagtccgggaacccccccggccgtagacagcctccttctccctccccagccatttgccgagtccaaccgtctcagcagcgcatccgttctctctctggattccgtcgtcggaaacaagactgactacaagctacaaaaggttgatcctttcttcacggatcagactggcgagtactacaggatatttgacaagaagttggatgtcctcaacggatccaactctgagtcgcagctctgtatcgaagagttcttgattaagagcgaacaagagtggttcgacaggttccgtaatgccagactgggtcgcaacaagtctcccactccgtcaattcgccattcatcgagaaacaccgccaccccagacacaatgttctacaatgatgacctcgcctccaacgtgaacagcgacgaagataaccatctccaagatgatgagttccttctcggaaaggactatgtccctcccactgggcttaagaaatggatgcaggtcaaaattggagactggccgatctactccatgttccttgctctgggccagatcattgccgcaaactcctaccagatcactctactcacaggtgaagttggtcagactgcggagaagttgtatggaattgcgacaacatatgccattgcatccatgtgctggtggctcgtgtaccgatacttcaagtctgtcgtctgcctttctaccccgtggttcctgtacgctactgctttcctcttgattggatctgctcactgggaaggagattccttcacgcggggatggatccagaatgtcggcaccggtttctatgccgcggcctccgccagtggatccattttcttcgcttcaaactttggtgacgagggtggtgctccagttaaaacctggattttccgcgcctgtgttattcaaggtattcaacaggcatacgttattgccctctggtactggggttccaccatgaccaaagcttcgtcagagggtctcttgaaccctgagaccaacattgccaacagctggaaaatgaggtaaatacacctgcccacctatgtcctgaattgtttttttactgacagattccagtgcaatctgttaccccatctgcatcttcctgtgtattgtgggtgttttgttggctatgggacttcccaactactaccgccaaaagccaggcaaggtgccatccttctacaagtcccttttccggagaaagatcgtcacttggaacttcatcgccgtcatcctgcagaacttcttcctcagtgcaccatacggtcggaactggagctgtaagtccaattctcccattccaatttttgcataccgaccaatactaacatcccccctcccagtcctatggacctccatacacacccacgcatggcagatcgtcatcctctgcatcgtcttcttcggcttcgtctggtgcatcttcctctttgtcgttagcagattctcaaagcgacacagttggttccttcccgtcttcgcctgcggcctgggcgcaccccgcttcatccaaatctggtgggctgtctccggcatcgggtactacctgccctgggccggagggtacacatccggcgcgctcgtctctcgcagtttgtggctgtggctgggcgtgttggattccatccaaggtcttggattcggtatcatccttctgcagactctcactcgagtccacatgtgtttcgctctcattgcatctcaggtgataggttccattgcgactatctgcgcccgagctttcggtccgaacaatgtgggacctggcccaatctctcctgacatgacccagggcgcccattccttggctaatggctggttctgggtggctttgttctgtcagttgttggtctggtatgttgatctttgcttgtcttgcttggtggaatgctcgctaacgtttatctgcagtgccgggttcttgctgttcttccgtaaggaacaactcgccaaaccataa

SEQ ID NO: 73 - protein, 436 aa, Penicillium chrysogenum
MIEPTSFSSSRSGSPQRSDANSPVHSPIAVDTPSTEAGDPFDNLHDLLRRLPLQSHILVTGGLGFIGSHTTLELLKANYNVIVIDNLSNAFENVVGRISLLAKKHHEENGTKMPSLRLHAHDYRDTEALQSLLEEYQLPSRWGTPKSRIAGVIHFAAYKAVEESIRKPLKYYSNNVSGLVDFATTLGDFGIKTFIFSSSATVYGSLATSGLPLKEELCVHKEELYTDHEGSQQFIQPGCTGITNPYGRTKWMCETILADLAASDPEWTIVALRYFNPVGCDSSGLLGEDPRQAPTNLLPVVVKVITGQYSELSMFGTDWETEDGTAVRDFIHVSDLARGHIAALSSANEGKLTENFRTFNLGTGKGNSVMDVVSTMESVTEKHIPRRAAPRREGDVGACVAVVDRSTEELQWKTEKSLKDACRDICNFLDISGLSS

SEQ ID NO: 74 - DNA, 1311 bp, Penicillium chrysogenum
atgattgagccaacatcattttcctcttcaaggtcgggcagccctcaaaggtccgatgcgaacagtcctgtgcactctcctatcgctgtggacacaccgtcaacagaggctggagacccattcgacaatctccatgacttgttgcgcagactccctttgcagagtcacattcttgtcactggcggcctcggtttcattggtagtcacaccacgcttgagttgctcaaggcaaactataacgtcattgtgatcgacaatctcagcaatgcattcgagaatgttgtcggccgtatcagtctcttggccaaaaagcatcacgaggagaacggcacgaagatgccatctctgcggttgcatgcacatgactatcgcgacaccgaagctcttcaatcactgctcgaagaataccagcttccatcccggtggggaactcccaaatcgagaatcgccggagtcatccactttgcagcttataaagccgtggaggagagcattcggaagccactgaaatattactctaacaatgtcagcgggctggtcgactttgccacaacacttggtgacttcggcatcaagaccttcatcttctcgtcttccgccacagtatacgggtccctcgcaacctcgggtcttccattgaaagaggaactgtgtgttcacaaggaagagttgtacacagaccatgaaggctcacagcaattcatccaacctggatgcaccggaatcaccaacccgtacggacgcacgaaatggatgtgtgaaaccatcctagctgacctcgccgcatcagaccccgaatggaccattgttgcactccgctatttcaaccccgttggctgtgattcttccggtcttttgggcgaagacccaagacaggcaccaacaaacctgcttcccgtcgttgtcaaagtcattaccggccagtattcagaactttcgatgtttgggacagattgggaaaccgaagatggcactgccgtccgtgacttcatccacgttagtgatctggctcgtggacatattgccgcgcttagttcggccaacgagggcaagctgacagagaatttccgcacattcaacctcggaactggaaaagggaattcggtgatggatgtggtcagcactatggagtctgttactgagaagcacattcctaggcgtgccgcaccacgtcgcgaaggtgacgttggagcctgcgttgcggtagtcgatcggtcgacggaagagcttcagtggaagacagaaaagagcttaaaggatgcttgccgggacatctgcaacttcttggatatcagtgggctgtcttcgtag

SEQ ID NO: 75 - protein, 299 aa, Penicillium chrysogenum
MSDSEKHVSKRTCLKSKRSRFILATVALIVIIAAVVPSVVVTTLKKNSMGPKAKVFVPLYIYPAPEAWAPLENVISTHPNVNFTVVINPGNGPGPDSLPDGNYTREIPKLTAYDNVRVLGYVHTSYGKRNFSAVRKDIQTYADWPTNSSNPNLAVRGIFFDETPQQYDAQTLTYLQGLTDFAKNLKGLGPDQFVVHNPGAIPDSRYLATADSTVVFEAAYSTFQEREGAKLFSNIADSNRTQLCAIVHSVPESVEGKHLRGLVKQVRKVAEEVYITHLSTDYYSSFGAKWTEFVDLMAA

SEQ ID NO: 76 - DNA, 2603 bp, Penicillium chrysogenum
atgattgctgccccagtctgggctttgaaggtcggttgctactacgcctttataacatgcgacactgcccccggcgtttggcctgagaagacgccgactgtcatcacctatcaccctccagtctcgactccttctagtactcctactagttctgctggagtgagttccaccacggtcgctacttctacacactctttcacttcctctttgtcctctacccctgttaccagttcgcctagcacgagcactacttctgtaacatcaaccttcgttacttttacctcgtcgggttcaatctcgtccgactctgtttcagagtccgtaatcgtcactgtcccatctggtacctccagcgtccctacccagagtgggacattgtctgtttcatccagctcatccgctattcccagcagcctggtctcttcgtcagtcgtttcttcttcggctgtttcgactgcacctgtttccacaagtgcttctgtgactactcctagaatgtcgtccacagctatctcaatctcggcttctccctctgccacctcgctcaaccacgctactgttgcagctgacattcttgtcattgctagagatgctgccgctgcaggtgtggccagctctgggctcaatggatacggtatcccatttaccactctgcttgttccctctgctggtgttgctcttcccgacctcaatggcaccgctggaggaaactttggtggtattgtcgttgcctctgaagtcagctatgagtatggtggtgacgtgggcttccagagtgccctgaccacggatcagtggaaccagctatatgcttatcagcttgaatacggtgtccgcatggtccaatatgatgtctacccgggtcccaagttcggtacatctgctctcggtggatgttgtgatgacggcatcgagcagcttgtctcattcactgatattagcgatttccccacatctggcttaaagactggtgcaggtgtcagcaccagtggtctgtggcactatcccgcgactatcagtaacaccacctctaccaagcaaatcgcctcgtttggccccactacagggttcactactgagagcgctgctggtgtgatcaacaacttcgatggccgtcagcagatggccttcttcattggtttcgacactaattggagtgctacatccagctacctgcagcacgcatggatcacctggatcacccgcggtctgtacgccgggtaccgccgtgtcaacctgaacacccagattgatgacatgttcctcgagactgaaatttactcgcccgctggtgaaaacttccgtatccgcgcccaggatatgatcaatattgccagttggacggatgagatcaacgccaagatgcccgccggcagttcttactttgtcgaggtcggccataacggtaatggaaacatcgagaactcttctgatacatcggatgctggctgggattcttgcggatctgctattgaatatgactcgcctcctgacactgagcccgaatggatgaaaccgcttggtactggcactgacctgtggcccgccgcccctactgcttatgactggactaatacttgcactgccatggatgaactcctgacctggtggaccaccgaaagcaacctcaacaagttcggtcatgtttcccacaccttctcacacgaggagcagaataatgctacctacagcgatgtctacaaggagatcagtttcaaccaggcttggctaaaagccgtcggtatcgataaggccaccaagttcacttccaacggtatcattcctcctgccattaccggtctgcacaatggcgatgcccttcgcgcctggtgggagaacggcatcactaactgtgtgggcgacaacacccgccctgctcttctgaacaaggagaatgacatgtggcctctcttcacaactattgccgccaacaatttcgacggcatgcagatcaaccctcgctgggccactcgcatctactataactgcgacactcctgcctgtaccgttgcagaatggatcgccacctctgctggtgccggtaccttccaggacctcctcgccattgagaaggctgagaccatgcgccatctgttcggcctctaccatgatggttatatgttccaccaggccaacctgcgcaacattgatgttaccccaattaccatcaacggtgtgtctgagaagtactccattatgcaagcttgggtggaggtccaggtccaggagttcgtccgcctggctgaatggcccatcatcacactcacacaccaggaggtaggatgaaccccatctaacatgttacaacgcctcattcattcgctaactcgtcatagatgtccgcttccttccttgcccgtttcaaccgtgacaagtgcggctactctctgagctacgccactagcaaccagaagatcaccgctgtcactgtctctgccactggcaatacctgcactgaacccattccggtgaccttcccagttggtcctaccagcacccagggcttcgccactgagcagctaggtgctgacccactgaccgtctgggttaagctcactggatcccctgtcacattcactctctccactcccattttcctttaa

SEQ ID NO: 77 - protein, 319 aa, Penicillium chrysogenum
MGEPSSKAGWWAWSTRKKVLIFGTVALVIIALGVGLGVGLGISAKNGGDDDNDNNNEGTGSNTTTPTNTTVRWQPPVGAKWQIILKSEDEPISTSVNAPIYDIDLFDNNKTFISNLQKMDRKVICYFSAGSFENWRDDAGDFNDADKGDDLDGWPGEKWLNVKSTNVRKIMQTRLDIAVEKGCDGVDPDNIDGYDNANGLDLTKAEAIDYVNWLAAQSHSRGLSIGLKNGAGIIDSVIDNMQWCVNEQCAEFDECDTYAPFIEADKPVFHIEYPKGGNTNNDKSVSASQAKSACTANSSGNFSTVIKNMDLDNWVEYCP

SEQ ID NO: 78 - DNA, 960 bp, Penicillium chrysogenum
atgggtgaaccatcatccaaggcgggctggtgggcttggtcgaccaggaagaaggttcttatcttcggaaccgtcgcccttgtcatcattgctctaggtgtcggactaggtgtcggactggggattagcgccaagaatggcggagacgacgataacgataataacaacgagggcaccggttctaatacaacaacaccaaccaacacaaccgtgagatggcagccacctgttggcgccaagtggcagatcatcctgaagtccgaggacgaaccgatatccacctcagtgaacgcaccaatctacgacatcgatcttttcgacaacaacaagaccttcatttcaaatctccagaaaatggatcgcaaagtgatctgctacttctctgccggctcgttcgagaactggcgcgatgacgccggcgatttcaacgacgcagataagggcgacgatctcgacggatggcccggcgagaaatggttgaacgtcaagtccacaaacgtgcgcaaaatcatgcagacgcgtctcgatattgccgtagagaagggctgcgacggcgtcgaccctgataacatcgacgggtacgataacgcgaacgggctggatctcactaaggctgaggctatcgactacgtgaactggcttgctgcccagtcccacagccgtggtctctcaattggactgaagaatggcgctggcattatcgactctgtcattgataacatgcagtggtgtgtcaatgagcagtgcgctgagttcgatgagtgtgatacctatgcgcccttcatcgaagcggacaagcctgtcttccatatcgagtaccccaagggtggtaatacgaacaatgacaaatctgtgtcggccagccaggcgaaatccgcttgtacggccaacagctctggcaacttctcaactgtcatcaaaaacatggacttggataactgggttgaatactgcccgtga

SEQ ID NO: 79 - protein, 847 aa, Penicillium chrysogenum
MIAAPVWALKVGCYYAFITCDTAPGVWPEKTPTVITYHPPVSTPSSTPTSSAGVSSTTVATSTHSFTSSLSSTPVTSSPSTSTTSVTSTFVTFTSSGSISSDSVSESVIVTVPSGTSSVPTQSGTLSVSSSSSAIPSSLVSSSVVSSSAVSTAPVSTSASVTTPRMSSTAISISASPSATSLNHATVAADILVIARDAAAAGVASSGLNGYGIPFTTLLVPSAGVALPDLNGTAGGNFGGIVVASEVSYEYGGDVGFQSALTTDQWNQLYAYQLEYGVRMVQYDVYPGPKFGTSALGGCCDDGIEQLVSFTDISDFPTSGLKTGAGVSTSGLWHYPATISNTTSTKQIASFGPTTGFTTESAAGVINNFDGRQQMAFFIGFDTNWSATSSYLQHAWITWITRGLYAGYRRVNLNTQIDDMFLETEIYSPAGENFRIRAQDMINIASWTDEINAKMPAGSSYFVEVGHNGNGNIENSSDTSDAGWDSCGSAIEYDSPPDTEPEWMKPLGTGTDLWPAAPTAYDWTNTCTAMDELLTWWTTESNLNKFGHVSHTFSHEEQNNATYSDVYKEISFNQAWLKAVGIDKATKFTSNGIIPPAITGLHNGDALRAWWENGITNCVGDNTRPALLNKENDMWPLFTTIAANNFDGMQINPRWATRIYYNCDTPACTVAEWIATSAGAGTFQDLLAIEKAETMRHLFGLYHDGYMFHQANLRNIDVTPITINGVSEKYSIMQAWVEVQVQEFVRLAEWPIITLTHQEMSASFLARFNRDKCGYSLSYATSNQKITAVTVSATGNTCTEPIPVTFPVGPTSTQGFATEQLGADPLTVWVKLTGSPVTFTLSTPIFL

SEQ ID NO: 80 - DNA, 2603 bp, Penicillium chrysogenum; identical to SEQ ID NO: 76

SEQ ID NO: 81 - protein, 2873 aa, Penicillium chrysogenum
MNGVESLPSRPHPLGWDAMKEHWWQFVFIGVLLFTVTTGSLSIIYSGVKSLIKYYKSRPLPDNVPSAVSKRLAKLANRELNLIDRRPCKGKPVSFGVYLGSFENPPTASQERLLQEWDILVVDPFQTGVAKAISRHERSQVIGRVDFGKFLPPKASALTVIEKIEELLAIGFNDTAFSGVLLANWEDVLRPTARRKLLETISSLGLAVYLESEPPHFLKDRKAVQSDAVAGLVIRNASIMPQGEKRDYFQLAELQATIKAFVSESCMRDFVVMAWETVDDNVTVSNAIVRRSIQWCGFYSAITWIGPEAALRDADLNVTTLEPLPAFGWLKEAEIMKAHDIWRANLNILPSPDTKAGWDILKPIFPAIDALLDSSEYDPKAPDSPTARLRDPPEWVAQVKSQGSPLSISMSGMAYNSLGCFPLGSDSNPLAFAEIVQSQRRLKSLNLLHPVPTSKIQSIGLLLRQFYDSLDFSGDDEHLANTIKDLANWASDDLLHVNLCLDSGLRKSSDLRFWAVFDMEHDGIEIYVSKNAQGLAGTVLHTFLSAKGFPRHVCFEAEATFATWSQNVSHDTGLPRRLIQDIDALSPEERLLLLQHLSLTGSHSELSKVICTYIRKQLVDAPSFAQLKALNTVGYLEKSTSPEELIRSRINWYMDQGCNYPSLEVCLGLFNQADSVLFDVLRYRREDDLAAITSGLCALLQGGSVDAYVDMMALALFCAARRGAFDEIYAEVTDRNPLFNNHTDQAAAFAESFALGSRCEAYFDVAPSVFGKLLSDRFRAYYGDHQPPNWVNGAPQLATSYAGAQIDVNPDEQPKTMPGYQRFTFLSVFAIPALIDIILLTMVGRGLYLSAAMSHDEQDSATMALMISLLLSGAIGTWIACGGPYYLISMAFAAANMFVLIRLIAGIAFTVAGGLIGFVAISGVRGPRAGIIFYLYLIALTIYFSTFASLASFSYPGSTFLSGRKSIIMCIPILFLSPIITAWTGHDSAVYLTVIYIFIGVLLLSLRSVTSKWVTWYQSVRRTDDTEIRKWYISAHGKNDEKVFANMSDPAALKLAREALSKEVLAETTRGIFSKASKDKMVVELARDWESTNFLLDWYCRYADVPRPIPFSSGWNIQTKVALDTLRNSQKGLHLHNAFVHWRQSSKEMGCGVLYFVIALLDKWAQLLSGDRMLAFLPAENDANRMAVGFALAYYLIGAVLIDTKAQELHDALGSKPPLSVRSAKDIRLVQKQEVQLRRKVYWRVLFRFLLWHVWSLALATALIWTFQSMVEGMTIFFSYVLAYTGLIWYQYTKIFTGPHALKPLIIGICIGLPVGIALRVSLPDNKYSQIIGLGAATWTVAILSMWNAKMGMPNKVDSPVELGRTFHAFTTPWSDPEWSQQELQTFFESYSLLPSDSRFRLNPGVHPGVEIKSVMLSRREELRIEEAFPCSKNIVNTAITSWEKGDIVIELVSPGSLGPGIRALSCSTGNQLKLAIAVGGLLDERLDISANCQVIAETLLHAATELMMGVPHEYASLAGSIVSGGVTHTMARQLREEANTTTVVRWAKKELLRQLCLGFEPDLHWDKLPTEVRDVLLKRCLGEQCSLSNSQREWLQQNLCTFDTDDLNVHVARCNLGAATAVSVLDYAHWGTGETALPKEPETSKYISYIPRKLPMALSLVRSPASYIYHKLGSLVKFFVVALVADPEFQREFNHVTQTLPTVVRVPIVFLLNMVWVYSKIVQNLGLSFFVFHGRKNVKQLWEETKGMTIHIKKNRVIVQSLEGTFTTFRHHEIDGGFKVYHYSGEHNTEPKEVKSLKYVSTYSSEMLLLVKQEFKDGKVVNEYHYDYQAPTKKGFKLTKSSNRIPLGRRCVSGANHLQSVQYNRKGLIESGSYMKDGNLIRFKYHYRKNPRFGDELLRAEFVLSHISCTVSWCAPPRRHPEKVERWIPHSKVTEASFVQGADVYESRWLYDHKFHPTIFTTINGQKMQTPPMIEHDYLGVLAKPKYTSFVHDNPFVYCDSLQSNILTRALGLTKKRFVVSTSQARSLMWKAWKDRVDFDAIIVRWMDDRILRRDKVLSPYWRSRDWGNLTSAKKYMDLRADAIMASADLDDNVSSWTPLAVKLTDLLSFGSGGDSVVNTRSKNFGTDTDKTLHVMAADNGTWPNEGGGVSACRRDMINSLSTIKWHMICESANDFGVPKHQTEQNIQSLKIIPLWGMDFLTPTHGLFHNKLDAEVDNVTSASEFDIKMNFIPILTALVKGARAVHLSKSDIHQATRALVNLNTYFQESRHWTQVWNSEMVKQSWRDLWLTQEMPNTIPSSQWFDTELPTLGSLDIALELWYRYLFIFSIPVPEKIPSTFQASHHSVSASYGVVCKIKRNCTLQIWDHAIAWRETNLCLSSALCKLSPFVRNALLGLMRITSVLTLHHADIILPCADFFNPGWEVEIGTCQGTIEHRNTFRRKIDPVVNGITDMQKFSPVKEIKSERPTVTMLSHVWYAKDIKTALLAADIIINQWKFDEYHLDIYGAIDKAPTYSTECQEIIASKGLRGRVTLCGTADPMKVLENTWLFLNSSLSEGLPLALGEAALTGAPVVCTDVGASLRVLSDPDDFSRFSAVVAPNDALALAKAQIGMLAMLGEWSKHSDDASPAPVLTSSPTPEEVAAITRRMYEKSEHRRKLGMMTRKIVQKSFSGDRYLREHEQMLWIGKSAKMMASRAAGDPIEPADVAAAIETGVDEEIIAIPRGVVHSWRSSAQSGISTIYSSASQIPGRGGLHRPASDISAMSMSMSNVSTDTESFGRLPVFAPRPTVLPNGGSPGNMSPMWTSNHRLSALNAGPHSRPQSYSRSVSTAGREQLRGLQREDFLPYRNSDISVANRDDFLRAGGLDPSQAS

SEQ ID NO: 82 - DNA, 8780 bp, Penicillium chrysogenum
atgaatggagtagaatcactcccatccaggccacatcctcttggttgggatgccatgaaagaacattggtggcaatttgtatgttgaccctggtcctctttacaacttgacgtttggcactctcgtcccaaacgcagagcacgaagatttgctgactattttccctaggtattcattggagtgttgctattcacagtcaccactggctctttgtcaatcatatattctggtgtaaaaagtcttatcaagtactataaggtatgatatagcggtcaccgacaagctgttctcctctagtctgaatattaattccagtctatttttagtcgagaccgctgccagataatgtaccctcggctgtgtccaaacgtctggccaagctagccaaccgagagctcaacttgattgacaggcgtccatgcaagggaaagcccgtgagcttcggagtctatctgggaagtttcgaaaacccacccactgcctctcaagaaagacttttgcaagaatgggatatcttggtcgtggatcccttccagacaggtgtcgccaaagctatttccagacacgagcgcagccaagtaataggacgtgttgattttgggaaattccttcccccaaaggcatccgctctgaccgtgatcgaaaagatcgaggaattgcttgcaattggatttaacgataccgctttttccggtgttctcctcgcgaattgggaagatgtgctccgtcctaccgctcgaagaaagcttctcgagaccatcagcagcctcggcctggcagtatatctcgagtctgagcctcctcatttcttgaaggatcgaaaggccgtgcagagcgatgccgtggcgggtttggtcattcgaaacgctagcatcatgcctcaaggcgaaaagcgggattatttccaactggccgaactgcaagcaacaatcaaggcatttgtttctgagtcttgcatgagagactttgttgtaatggcctgggaaaccgtcgacgacaatgtcactgtttccaatgccatagtccgcagatctattcagtggtgcggcttttacagcgcaattacctggatcggccctgaggctgctcttcgcgatgcggatcttaatgtcacgactctcgaacctctccccgcgtttggttggctgaaggaagcagaaattatgaaggcccacgacatctggcgtgccaacctgaacatattgccttccccggataccaaggctggctgggacattctcaagccgattttccctgcgatcgatgcgctactggattcgtcagaatacgaccccaaggcacccgatagcccaactgctcgactgcgtgatcctccagaatgggtcgcacaggtcaagtcacagggcagccctctctctatctccatgtcagggatggcatacaattcgcttggttgcttccctctcggctctgactcgaacccactggcctttgcagagattgtccaatctcaacgacgccttaagtctcttaatcttcttcatcccgtcccgacatccaaaatacaaagcattggactccttctacgtcaattctatgactctctggatttctccggagatgacgagcatttggccaacacaatcaaggatcttgcgaattgggcatccgacgatttgttgcatgtaaatctttgtctcgactctggtctgcgcaagagctctgatctccgcttttgggccgtttttgatatggaacatgatggtattgagatctatgtatccaagaatgcacaaggcctggctggaactgttcttcacaccttcctctcagcaaaggggtttccacgccatgtttgcttcgaggcagaggcaaccttcgcgacctggtctcagaatgtgtcccacgatactggcttacctcgtcgactgattcaagatatcgatgctctcagccctgaagaacgtctccttctcttgcagcacctctctctgactggttcacatagcgagctatccaaggtcatctgcacatacattcgcaagcaactggtcgatgccccctcttttgctcagttgaaagcgctgaacacggttgggtatcttgagaagtccacctctcctgaggaactgatcaggtctcgtatcaactggtatatggatcaaggatgcaactacccatctctcgaagtctgtcttggtcttttcaatcaggccgacagcgtactgttcgatgttttgaggtatcgccgcgaggatgaccttgccgccattactagcggtctctgtgcgcttcttcaaggcggctctgttgatgcatatgtggacatgatggctcttgcgcttttctgcgctgcaagacggggagccttcgatgagatttacgcagaggttacggatcggaatcccctttttaacaaccataccgatcaggctgccgccttcgcagagtcatttgccctgggatctcgatgtgaggcttacttcgatgtggctcccagtgttttcggaaagttgctatccgaccgattcagagcttattatggagaccatcagccgccgaactgggtgaacggagctccgcagcttgctacatcctacgccggagctcagattgatgtcaaccctgatgaacagcctaagactatgcctggataccagcgattcacattcttgagcgtcttcgccattccagctctgattgatattatcttgcttaccatggttggccgtgggctttatctctctgctgccatgtctcatgatgaacaggacagtgcaacaatggcgctgatgatctccctgctgctttccggtgcaattggtacctggattgcatgtggcggtccttactacctcatttcgatggcgtttgcggcagcgaacatgttcgttctcattcgtctaattgcaggtattgccttcactgtggccggtggcttgatcggctttgttgccatttcaggtgttcgaggccctcgcgctggtatcatcttctacctctacctgatcgctctgacaatctacttctcgactttcgcctcgcttgcaagcttcagttatcccggctcgaccttcttgtcaggtcgtaagtcaatcattatgtgcattccgatcctcttcttgtcgccgatcatcacggcctggactggccacgactcggctgtctatctcaccgttatctatatctttattggtgtgctcttgctctcccttcgttcggttacctccaagtgggtcacttggtaccaatccgtgcgacgcactgatgataccgagatccgcaagtggtatatctctgcccacggaaagaatgacgagaaagtgtttgcgaacatgagtgatccggctgccctcaagctggcgagagaagccctatcgaaggaagtcttggctgaaacgacgcgaggtattttttcaaaggcatctaaagacaaaatggtcgttgagcttgcccgggactgggagtctaccaatttccttctcgactggtactgtcgctatgcagatgttccgaggccgattccgtttagttctggttggaatatccaaaccaaggtcgcacttgacaccctacgcaactcgcagaaaggtcttcatctgcacaatgcattcgttcactggcgtcagtcaagcaaggagatgggatgtggtgttctctactttgtgattgcgcttctcgacaaatgggcgcaactgttgagtggtgatcgcatgcttgcttttcttcctgccgagaatgatgctaatcgaatggccgttggctttgcccttgcctactatttgatcggagcggtcctcattgataccaaagcccaggagctccatgatgcccttggcagcaaacctcctctttccgtcagatctgcgaaagacattcgactcgtacagaaacaggaggtacaactccggcgcaaggtatactggcgtgtccttttcagattcctcttgtggcatgtctggagccttgcgctcgctactgccctcatttggaccttccagtctatggtcgaaggtatgactattttcttctcctacgttctcgcctacacaggcttgatctggtaccaatacacgaagatctttacgggtcctcatgcactgaagcctctcatcattggtatttgtatcggattgccagtcggtattgcgctcagagtctctctgccagataacaagtactcgcagatcattggactcggggctgccacctggaccgttgccatcctctcgatgtggaatgccaaaatgggtatgccaaacaaagtggactcaccggtggaacttggccgcaccttccatgcgtttacgacgccttggtcggatcctgaatggtcccagcaagagcttcagactttcttcgaaagctattcgctgcttccttccgattcccgattcaggctcaatcctggtgtccatcccggcgtggaaatcaagagtgtcatgttgtcccgcagagaagaacttaggattgaagaggcgttcccttgctccaagaatattgtcaacactgcgatcacatcctgggagaagggcgacattgttattgagcttgtctctcctggctctctcggtccgggcattagagctctcagctgcagtaccggaaaccagctaaagttggccattgccgttggagggctcctagatgagcgtctcgatatcagcgcaaattgtcaggttatcgctgaaacattgcttcatgctgccacagagcttatgatgggtgttcctcatgaatacgcatcgttggcagggtcaatcgtctccggtggagtaactcacacaatggctcgacagcttcgcgaggaggccaacacaactacggtcgtacgctgggctaagaaggaactccttcgccagctttgtcttggtttcgagcccgatctccattgggacaagctgccaaccgaagttcgagatgtgctgttaaagcgttgtttgggtgaacaatgcagcctctccaatagccagcgcgaatggctccagcaaaatctttgcacattcgataccgatgacctcaatgtccatgttgcccgttgcaaccttggagctgccactgcagttagcgtccttgattatgctcactggggaactggagaaactgctcttcccaaagagcccgagacttcgaagtacatttcctacatacctcggaagctcccgatggcattgtcgctagtccgatcaccagctagctacatttaccacaagctgggatcattggtcaagttcttcgtggtggctttggtcgcagatccggaattccagagggagttcaatcacgtcactcagacccttccgacagttgtccgtgtgccaatcgtattcttattgaatatggtctgggtatattccaagatcgttcaaaatttgggcttgtcattctttgtcttccatggccgtaaaaacgtcaaacagctgtgggaagagaccaagggcatgacaatccatatcaagaagaaccgggtcattgtccagagtctggagggcacctttacaacattcagacaccacgagattgatggtggtttcaaggtctaccactactctggtgagcataataccgagcccaaggaagtcaagtccttgaagtacgtcagcacttattcgagtgagatgttgcttctggtcaagcaggagttcaaggacggcaaagtggtcaacgaataccactacgactaccaagccccgactaagaagggtttcaaacttaccaaatcatcaaaccgtattccactgggacgacgctgcgtgtcaggggcaaaccatctgcaaagcgtgcagtacaaccgcaagggtcttatcgaatcaggttcctacatgaaggatggcaaccttatccgtttcaagtaccactatcgcaagaacccccgtttcggcgatgagttgctgcgagccgagttcgtcttatcccacataagctgcactgtgtcttggtgtgcgcctccgcgacgccatcccgagaaggttgagcgctggattcctcactccaaggtcaccgaagccagctttgtccaaggcgccgacgtctacgaaagtcgttggctgtacgatcacaagttccatcccaccatcttcaccaccatcaatgggcagaagatgcagactccgcccatgattgaacacgattatctgggtgtactggccaagccgaagtataccagctttgtccatgataacccctttgtctactgcgacagtctccagtcaaacattcttacccgggcactgggccttacgaagaagcgctttgttgtgtcaacttcccaggctcgctccttgatgtggaaggcgtggaaggatcgtgttgacttcgatgcaattatcgttcgctggatggacgaccgtattctgcgccgagataaggttctttccccttactggcgcagccgtgactggggcaatcttacatctgcaaagaagtatatggatctccgcgctgatgcgatcatggccagtgcagatctggacgacaacgtttccagctggaccccgctcgctgtgaagctcaccgatctgctcagctttggttctggtggtgattccgttgttaacacccgctccaaaaactttggcactgataccgacaagacacttcatgttatggcggcagacaacggtacctggcctaatgaaggtggtggtgtctctgcctgtcgacgagatatgatcaactccctgagcaccatcaaatggcacatgatttgcgagtcagcaaacgattttggtgttccaaagcatcaaaccgaacagaacatccagtctctcaagatcatcccgctttggggtatggacttcctcactccaactcacggtttgtttcataacaagctagatgccgaggtggacaacgttacatccgcgagcgagttcgacatcaagatgaacttcattccgatactgacagctttggttaagggtgcccgtgcagtacatctctccaagtctgatatccaccaggcgactcgcgcgcttgtgaacctgaacacatacttccaggagtcccgtcattggactcaggtgtggaacagtgaaatggtgaagcagagctggcgagatttgtggctgacccaggagatgccaaacaccatcccgtcatcccagtggttcgacactgagcttcctactttgggttctctcgacatcgccctagagctctggtaccgctatctcttcatcttctcaatcccggttcctgaaaagattccttcaaccttccaagcctcacatcacagcgtcagtgcctcttacggtgttgtatgcaagatcaagcgcaactgtaccttgcagatttgggaccacgccatcgcttggcgtgaaaccaatctctgtctgtcgtctgccctgtgcaagctctcgccatttgttcgaaacgcactccttggattgatgcgaataacctccgtcttgacccttcaccacgcagacatcatccttccctgtgcagacttcttcaaccccggttgggaggtcgagattggtacctgccagggcacgattgagcaccgaaacactttccgccgaaagatcgatcctgtcgtcaacggtatcaccgacatgcagaagttttctccagtcaaggaaatcaaatccgagcgcccgactgtgaccatgttatcccacgtttggtatgccaaggacatcaaaactgcccttctcgctgcggatatcatcatcaaccagtggaagttcgatgagtaccatctggacatctatggtgccattgataaggccccaacttactctaccgagtgtcaagagatcatcgcatcaaagggtcttcgtggcagagtcacgctctgtggaactgccgaccccatgaaggtcctggagaacacatggcttttcctaaactcatctctgtctgaaggtctccctctcgccctaggagaggctgctctgaccggagcccccgtcgtctgcacggacgtcggtgcttccctccgagtcctcagcgacccagatgacttctcccgcttcagtgctgtcgtggcaccgaatgacgccctcgccctagcaaaggcccaaattggcatgcttgccatgctcggcgaatggagcaaacacagcgacgacgcatcgcccgcgccagtcctgacctcctcccccacacccgaggaagtagcagccataacccgccgcatgtacgagaagagcgagcaccgccgcaaactcggcatgatgacccgcaaaattgtccagaagtccttcagcggtgaccggtacctccgcgagcacgagcagatgttgtggattggcaagtccgccaagatgatggccagccgcgcagctggcgacccaatcgagcctgccgacgtggcagccgccatcgagactggcgtcgatgaagagatcatcgccatcccgcgcggcgtggtacactcctggcgctcatctgcccagtccggtatctcgacaatctacagttctgcgtcccagattcctggtcgcggcggcctccaccgtcccgcatctgatatttcagctatgagcatgagcatgagcaatgtctctacggataccgagtccttcggtcgtctgccggtctttgcgccaaggcctaccgtgttgcccaatggcggctccccggggaatatgtcacccatgtggacctccaaccatcggttgtcggcgctaaatgccggtcctcactctcgccctcagtcctactcgcgctccgtctcaactgctggtcgggaacagctgcgtggcttgcaacgtgaagacttccttccgtatcgaaactcggatattagtgtcgctaacagagacgacttccttcgggctggcggacttgatcctagtcaggcgtcttga

SEQ ID NO: 83 - DNA, 18 bp, Artificial Sequence
  primer
tctccatagtgttcacca

SEQ ID NO: 84 - DNA, 37 bp, Artificial Sequence
  primer
atataccgtgactttttagcacaacattggagctact

SEQ ID NO: 85 - DNA, 38 bp, Artificial Sequence
  primer
agtttcgtcgagatactgcgcgttgtcatatttgcaag

SEQ ID NO: 86 - DNA, 19 bp, Artificial Sequence
  primer
agggctcagaatacgtatc

SEQ ID NO: 87 - DNA, 43 bp, Artificial Sequence
  primer
agtagctccaatgttgtgctaaaaagtcacggtatatcatgac

SEQ ID NO: 88 - DNA, 43 bp, Artificial Sequence
  primer
ttgcaaatatgacaacgcgcagtatctcgacgaaactacctaa

SEQ ID NO: 89 - protein, 469 aa, Bipolaris maydis
MSACSSQFSVSPSATPEMVSTPATQSSVLFDDDVAADPLDIEGVGSSFIMVVGGLGYIGSHTTLELLKEGYNVLVIDDLSNSYQNVLDRVKFLAEEFCREQGRRLPALHFQQLDYRSPQMKIVLANYSSYSVSSKPVSALARRFPYTNLQRTDSGIEMETDDRQEPVIERRSRITGVIHFAAYKSVEESIRTPLRYYSNNVCGLVDFLGLIEQFGIKNFVFSSSATVYGEGANCGVPLREELCVHHPETFVDGEGRERQVLPGVLGLTSPYGRSKFMCESILADLAVADPTWSITALRYFNPVGCHESGILGEDPRQKPSNLIPVIATVMTGARPVLDIFGTDWNTPDGTAVRDFIHVVDLARGHIAALAASAAGRTKAPFRTYNLGTGNGHTVREVLHSLEEVSQRKIPAREVGRRAGDVGFCVAEVQRAETELQWKAERNLRDCAGDVWNFTKGRCPDVQEVSDAQC

SEQ ID NO: 90 - DNA, 1517 bp, Bipolaris maydis
atgtctgcatgctcctcacagttctcggtgtcgccatccgcgacaccagagatggtcagcacaccagcgacacaaagctctgtgcttttcgacgacgacgtagcagcggatccattggacattgagggcgtcggctcttccttcatcatggttgttggcggattgggctacattggctcccacacaacactggagctgctcaaagaaggatacaatgtccttgtaatcgacgacctcagcaactcttaccaaaatgtcctggacagggtcaaattccttgccgaggagttctgcagggaacaaggacgacgactgcctgcacttcactttcagcaattggattatcgaagtccgcagatgaagatcgtactggccaattactcttcgtattccgtcagcagcaaaccagtatcagcattagcccgtcgcttcccgtatacgaatctgcagcgaacagattccggcatcgaaatggagacggatgatcgccaggagccggtgatcgagcgtcgatcccggataacgggtgttatccactttgccgcctacaaatctgtcgaagaaagcattcgcacgccactgaggtactacagcaacaacgtttgcggtctagttgatttcctgggcttgatcgagcaattcggcatcaagaactttgtcttctcgtcctcggctacagtatatggtgagggtgccaattgtggtgtgcctctacgcgaggagctatgcgtgcatcatccagagacttttgtcgacggtgagggacgcgagcgtcaggtgttaccgggtgtcttgggtctcacttcgccttacggacgttcaaaattcatgtgcgaatccatccttgcagatcttgctgtggcggatccgacatggtccatcactgctctgagatacttcaacccagtaagccctcattcaagtgacttttcaaacgagaaatgctaacggaacaaggtcggctgccatgaatccggaatactaggtgaagatccacgacagaaaccaagcaacctcatcccagtcattgccacagtcatgacgggagccaggccggtgctggatattttcggtaccgactggaacactcctgatggaaccgctgtgcgtgacttcatccatgtggtcgacttggctcgtggtcatatcgcggctttggctgcttcagcagctggtcgcacaaaggctccattccgaacctacaacctgggtaagctgcattttcgcctacagcccgcccctctagatgtggttgctaactctttctaggcactggcaacggacacacggttcgtgaagtgcttcacagcctggaggaggtgtctcaacggaagatcccagcacgggaagtcggacgaagggcgggagatgttggtttttgtgtggctgaagtgcagcgagcagagactgagctgcagtggaaggctgagaggaatctcagggattgcgctggagatgtgtggaactttaccaagggtcggtgtcccgatgtgcaagaagttagtgacgcgcagtgc

SEQ ID NO: 91 - protein, 53 aa, Bipolaris maydis
MEAFHTPVLQALLASHHPLTSFPKASMGGRHVLNDWTSVYLSITKVCTMPLIP

SEQ ID NO: 92 - DNA, 162 bp, Bipolaris maydis
atggaagcttttcacacaccagtgctgcaggccttgctcgctagccatcaccccctcacttcgtttcccaaagcgagcatgggtgggaggcatgtgctgaacgattggacgagcgtctacttgtccataaccaaggtttgcacaatgccattaatcccctaa

SEQ ID NO: 93 - protein, 340 aa, Bipolaris maydis
MDVKPTATTRSRRRKILCIVLPLVIVIVLALALGLGLGLGLNSGGDDDDNNNNGGSTPLPSPNNTLTWTPSVASTWQIILNHPPDVSSNNALTPNVSVYDIDLFDTPKSTIDTLHAQGIRVLCYFSAGSYEDWRTDAKDFKDTDLGKPLDGWAGERWIDLKSDNVRAIMKTRIQLAKEKGCDGVDPDNVDGYQNDNGLGLTPADSIAFMQYLSNITAPLNLALGLKNAGDIVTTVLPVVHFSVNEECVKYSECAEFAPFIDAGKPVFHIEYPDGAGAAQGLRANVLTDYCAKSGKGAGSDRFSTVLKKIELDGWVEYCDGSVDVTNVSEAVGGGRNNSSS

SEQ ID NO: 94 - DNA, 1189 bp, Bipolaris maydis
atggacgtcaaacccacagcgacaacgcggtcgcgccgccgcaagatcctctgcatcgtgctccccctcgtcattgtcattgtcctcgccctcgccctcggtctaggactaggactaggcctcaactctggcggcgacgacgacgataataacaacaacggtggcagcacgcctctcccctccccaaacaatacccttacctggaccccctcggtcgcctcaacctggcaaatcatcctcaaccacccaccagacgtctcctccaacaacgccctcacccccaacgtcagcgtctatgacatcgacctcttcgacacgcccaaatccacaatcgacacgctgcacgctcagggaatcagagtgctgtgctacttcagcgctggcagttacgaggactggcgcaccgacgccaaggacttcaaagataccgatctaggcaagccccttgatgggtgggccggtgaaagatggattgacctcaagagcgacaatgtgcgggctatcatgaagacgaggatacagttggccaaggaaaaagggtgtgacggggtagatcccgataacgtcgatggttatgtgagttttgttttttttattctctcttttctctacctcacaaccaccacttctttaccatgttaccaagccacacaaaaaaaaagttggaaagggtgctacaaggggggggggggggaaacgagtatgactacaaaaattgctaacggagaaatttaaaaaaaagcaaaacgacaacggcctcggtctcacccccgccgactccatcgccttcatgcaatacctatccaacatcacggcgccgctgaacctcgcactcggcctcaagaacgccggcgacatcgtcaccacggtactccccgttgtgcacttctccgtcaacgaagagtgcgtcaaatacagcgagtgcgccgaattcgcgcccttcatcgatgcggggaaacccgtattccacatcgagtatccggatggcgcgggtgctgcgcagggattgcgcgcaaacgtgctgaccgactactgtgcaaagagtggcaaaggcgcgggcagcgacaggtttagcaccgtcctaaagaagatcgagctcgatggctgggtcgagtattgcgatggcagtgtcgatgttactaatgtcagtgaggccgtgggtggcggccggaataattcttcaagctga

SEQ ID NO: 95 - protein, 689 aa, Bipolaris maydis
MSSYSRSLLRACLVSSLSFVLQPVSAFVGSATVSSTVLVIARDATSALNSASLGLQGYGIPYETLLVPQAGIANLPLLNASATNGNYGGIVVVGEVSYNYNDSYQSALTTAQWNQLYAYQTNFGVRMVRLDVFPTTEFGVVSTGGSLDDQPVTFTNTSAFPSANLKTGVPISIASIYHTPANITNSSIAWEFASFSNAGTAAVINQIGARQQMAWFLPFALDWAPSSNILQHAWITWITRGLFLGFRRIYLNTQVDDMFLETSLYRPEGQDFRVTPQDLTAHVTWQAALNARLPAGSEFFIEIGHNGNGDIEASAYTDLGQTRCSPARAIEYADQPDGSPEYTKPIGTGVNIWPTTPTSYTWSLQCAQIDPLENWFAVTSNRDSFAHISHTFSHMDLTNATYADTSKEISFNRAWLKQVGLDAAQRWSTKGLIPPAITGLFNGDAIKAWMDNGIANVVGDNTRPRLRNNQSSFWPLATTTSFNGYAGLNIMPRWATLIYYNCDLPACTTQEWIDTSAGAGTFDDLLDNARDTAIRNLFGLHWDPYMFHQANMRVADVPTTTINGKTGQFSLLMSWLEVVTSEMTRLTTWPMKTLKHDDMAQQFLNRQTRDLCRPSMTWKTSANGASIESVSVFTAGGNTCGTTIPITVPGSVADSTGATREQLGSDPLTLWVSMSGASRTYRLSSALPL

SEQ ID NO: 96 - DNA, 2361 bp, Bipolaris maydis
atgtcgtcctattctcgctcgttattgcgggcatgcttagtctcctctctttctttcgtgctgcaaccagtgtcagcgtttgtgggaagcgcaacggtctcaagcaccgttttggtcatcgctcgcgatgcaacttccgcgcttaacagcgcctcacttggtcttcaaggctatggcataccctatgagaccctacttgtcccccaggctggtatcgccaatcttccccttctcaatgcctctgcaacaaatggcaactacggtggtatcgttgtcgtgggcgaagtcagctacaactacaacgactcgtaccaaagcgcacttacaaccgctcaatggaaccagttgtacgcttatcagaccaactttggtgtgaggatggtccgcttggacgtctttcctaccactgaatttggtgttgttagcactggtggcagcttggacgatcaaccagtcacctttaccaacacaagtgccttcccttcagccaatctcaagacgtaagtgcaaaacgacccctttaccccaattgcaacaatttgcaacgatgcctgctcagcttccacaagcggcgctggtggcaaacgttgatagccagaaacacgaggtacacacaggactaatcatgatgacaggggtgtgccgataagcattgctagcatctaccatactccggccaacatcacaaactcttcaattgcatgggaatttgctagtttttccaatgccggtactgctgcagtcatcaaccagattggcgcacgccagcagatggcatggtttcttccatttgcgctagattgggcgccatccagcaacattctgcaacacgcgtggatcacttggatcaccaggggcctcttccttggtttcaggagaatctacctcaacacgcaagttgacgacatgttcctggagacgagcttgtaccgtccagaaggccaagacttccgcgtcacgccacaggatctcacggcccacgtgacatggcaggctgcgctcaacgcaaggctgcccgcgggatccgagttcttcattgagattggccacaacggtaacggtgacattgaagcatctgcatacacggacctaggccagacacgctgcagccctgcccgggctattgagtacgctgatcagcctgacggcagcccggaatacaccaagcccattggtaccggcgtgaacatttggcctacgacacccacttcatacacctggagtcttcagtgtgcccagattgatccacttgagaactggtttgcagtgacatcgaaccgcgactcttttgctcatatttcccacacattgtacgtgtacaattgctactaagaccctggccactgctgacaagacgctagctcacacatggacttgaccaatgccacctatgcggacacatcaaaagaaatttccttcaacagggcctggctgaagcaagtcggactcgacgctgctcagcgatggagtaccaagggtctcattccacctgccatcactggtctgttcaacggcgacgccatcaaggcatggatggacaatggtattgccaatgttgttggcgacaacacccgcccacgtctccgcaacaaccagagctcgttctggccattggccacgacgacgtcgttcaatgggtacgctgggctgaacatcatgccacgttgggctactctgatttactacaactgcgatctccctgcctgcactacgcaggaatggattgatacgtctgctggcgctggtacattcgacgatctattggacaatgcccgggatactgctatacgcaatctttttgggctgcactgggatccgtgagttctccgctcgtgtccgcttggagaaagtttactgagacatcacgcaggtacatgttccaccaggctaacatgcgggttgctgacgtgccaacgacgactattaatggcaagactggccaattctcgctactcatgtcgtggctcgaggttgtgaccagtgagatgacacgcttgtacgtcaatcatggccgcattcgattaagcaatgctgacacacctctctaggacgacctggcccatgaagacgcttaagcatgacgacatggcccagcaattcctgaaccggcagacgcgcgatctgtgcaggcccagcatgacctggaagacatcggccaatggcgcaagcatcgagtctgtgagcgtgttcacggcaggcggcaacacgtgcggtacaactattccaatcacggtgccagggtcggtagcagactcaactggcgcaaccagggagcagctaggcagtgatcccttgacgctgtgggtgtctatgagtggtgcgagcaggacgtacaggctctcttcggcattgcctctctag

SEQ ID NO: 97 - protein, 3043 aa, Bipolaris maydis
MAKPDVLGIEAFKDGTRIRDWWDWTLIAIIAASGFVGLVALVWSTYRSLRKVLKEDEDETALPRSVQERIHLLSNSSSVVRVTHALPAKPSSFGVYLGALQTPVTPEEAQVLSQWEALVLDYRQTGILEAVSNDAVPMGPYIIARLDLSHVITSAVKGTELDLSQAIYLLSCTIEQNLRRPDQKRYFTGVLIAEWRNRVPIALLHGLTKLLSAHGLDSYLEIGAPDFLDGVKKLDLSLFAGVVVRNGTIKSNGERRDFFDMDKMKTTTRSFVSQACQRSFVTMMWDTVDDNAELSHAVLRRAHMWCSYHGAVPYFPRQCALTNIYDVSSCEEPLAAFQWLKTRKVMDVHDKYRTARTISPGFSSLFDDYVPLQEIFPLLADTLAGLDGDMPNDDDSSSTLTLTVEYPEVDENGVLVPQEPSSPTSLGLDWTMAVEKHTDNPLSCSFDGSPYSSLGCFPIGIDASKADFDRVLKSQRHLRDLKLLSRLPVEQFSATAETLSRYASSSSHFLNLVPTMREAILALVEALDHAVEDGADPYRFQAYSALDSGFHTPNGASFWGVWELDPRTKAIIIYVSKSVQDVKGVLLHTYLSMMGFSRYQCFLAEYGLSEFAAGSFSPERLPDRLVQDLDLLSSSELLNYLQHIRYSEWEEECSLLPAIRERCKELLIDVPTYHQFKQLSNVDYIGEKVTDEELVNAKLKWYRLSRVPTLDEAQALQLFRHINEVFTSILWWRDHQKLDTITSAITDITSRGTLDSAADFVLFCIFCAARKAGFEEVYIEVSDRNPLFNQYSDQSAAFAELFALGSRCEAYFDIKPSDMGILLSEKHRAYYNQEEHQPPMWIFNAPSFASAYAAAQTDIDPEQKASVMPAYRRFTFLSVFAIPALVDIVLLSTTGHGLYLSVRMTEDDRYYATLALMCSLLLSGAIGTWISIGGTYYLISMAFSAANMFVLTRLVGGLAFTLAGCLLGFIVISAVSGPGHGAVFFFYLFGLTTYLTVLAVLSTYQIPGSSFLNGRKIIIMVIPTLVISPILTIFIGMKGHDIYLYLGVLYIFVTLLILGTRRVATQWVTWYHNIKTLNDSDIKNWYMKLHSEREQEATALKNRGQSKGPAISTVAGGSLVASSEGSFSEPDIFQGMSEPAILALCRNALHEAVLKEHGRHFWQKSTKDSFVKQLAGCWDSTLFLLDWYARITDTKRPIPYSSTWNLETQVALESMQQSQKGIRLHNSFIHWRTAGDEIYCGILYFLVALMDRWLDILNGGQIVDMPGADSPVQLSAGLGLAYDFAGEMDTALRLSVGFGLAYYLIGAVLLDYKAQHLHTLSEQMAPISIENTQQIKQAKANDLKFRRHLYFNTLCRFIGVHVWALAFCTALIWIFNSSSIGLTLFLSYVGAYTGLLLYQYNKIFSGPHALMPLLAAVVVGLIVGNVLLAVFPGFLYDRIIALAASTWTAALLSFRTAKLGMPEALDFSKWVSESFSSAKRSKKAANTVNAQPDDGTESPMSDKFHAYNSGNSDSEYSQSELRAYCNMIRAAAKENRYRVNPVGQPGDQIVALLLSCTHDSLSRQALQAFPAMPSTIQRIVSAWRNGQIDVFIVPLQAVVNFNNDLRAISHFADGHLTLYITSDAKGPGFGQTNVSSNCTAIAETLLHACMETFLETPHSQAEIAESILACRENDGEQYAISECNRRSMPALVAGQDALSYGKACRRELLRNLCLGFDCETQWDSLPLDIRRLFFRRCLGIRAPYTNKELSWIHENIRTEESCAILSVIARYDLGAYLAVVKYSYFRNRGDQSLSNKEYRQVTADIQTAYHPVLNRSAVSMFSLFTEYIRLPVAYVYHCAGTWVKFFVLACMADPEYQRELNGALLHKPWIVAKPTTFLLTGLWIYSRRAMSIALPFFLYHRRKDIAGLAGTVKGSLIIQRKNRLVIQSAGETETAFVHPDKDGGFKLIFYSGALKTEPTWGQIRVSHYDKEMRIKLRQEWKNGSVTNEFTYEYETNQTQSKIKISKVRSTKIPLSRICGKGENDGAKVLYNHKGHIESGSYISHNNLVRFKYHYRKNAKYDDELLRAEFVLPHMSANVSWCAPPVRHAEKTERWIPTPRVHEATFVQGADVYECTWFYDHKFHPTITTKLNGIMVDTPDMIRHDWLGVLKKPTRCTFADENPLLAFKTPTSNFLGRLFRRNIKQQEISTSRARSHLWKAWKKRNDLDGVVIRWVDEELIRKEALLRPYWRRRDRGSLVKAEDYLALHADAIMASSDLTSDISAWTPLAIRMSDLFSFGQGGDAVVFTRTKALQRDTDNSLHVIAVDTGTWPNEGGGVSACRRDLINNLRTIKWHMVVESANDFGLPKHQTEENVESLKIIPLWGLDFMHPNHGMFTNKLDSEVDHLVKAATLTDIETNFIPTLTALVRGARATTMTSADVKQATRALVNLNTYFQDSRHWKEVWTSDIVKDSWRKLWLTDDMPNAQPAKDWFHLFIFSIPIPDKIPHVFQASHHSVSASYGIVCKLKRNCTLQIWDHAISWRETNLYLSSAMCTLPPFIRNSLLGLMKLTSCLILHHADQILPCADFFNPGWEIEIGSAKGQLTHRNVFKRKVDPIVNGITDMTKFAPVTEIKAKTPTVTMLSHVWFAKDIKTALLAADIITNEWGFKDYKLDIYGALNKSPVYSSECQEILACKGLGQNVTMRGTADPAMVLANTWLFLNSSVSEGLPLALGEAALTGAPVVCTDVGASLRVLTDPDDGKRYSEVVAPNDAYGLARAQINLLAMLDEWAQYAEDGPGVAAPVLPHKPTPKDVEIITRRMYEKSDHRRKLGMMARNIVQKSFGGERYLREHEQMLWIGKSFYEMLDFEKQTPPPRNPARMLSLGRTRTVPQRDTMDTTSSSIFDPQMEKMMHPRRPFAQHRASAATSFSSVYIDDEDDSGPSSRYSPDLPWESEAWDTQPGSAGASTKYATSESDEWALPVIPRPTRTYSGTHIAPMRTPSSSVAPAKGKRPMQFQYAGSMAREDTGNGMLDPRRDVLARQSWAPNSGRSSLRRSHLNEMELA

SEQ ID NO: 98 - DNA, 9340 bp, Bipolaris maydis
atggcaaagcccgacgttctaggtatcgaagccttcaaggatggcacgcgaatccgggactggtgggattggactctcattgccatcattgctgccagcggatttgtcggccttgtcgctctcgtttggtcgacttatcgttctcttcgaaaagtgctcaaggtatgaaaagctgctgcaccgacatgcgcccaaactgacaaatcctgcaggaggatgaagacgaaactgccttgccacggtctgtacaagagcgcattcatctcctgtcaaacagctcaagcgtcgttcgtgttacgcacgcgctccccgccaaaccttcatcttttggcgtctaccttggcgcattgcaaaccccagtcactccagaggaggcccaggttctatcgcaatgggaagcgctcgtcttggattaccggcagactggtatcctggaggccgtcagcaatgatgctgttcccatgggcccttacattatcgcgcgactcgatctatcccatgttatcacttcggccgtaaagggcactgagttggacctgtcacaagcaatatatctcttgtcttgcacaatcgaacagaacttgcgacggccagaccagaagcgatacttcactggtgttctcattgccgaatggcgcaaccgcgttcccatcgctttgctgcatggcctcacaaaacttctttcagcccatggcttggatagttatctggagatcggtgctcccgacttcttggatggtgtaaagaaactcgacctctcgctctttgccggcgtagtggttcgcaatggtacgatcaagtcgaatggcgagcgtcgcgatttcttcgacatggacaagatgaagacgacaaccaggtcatttgtttcccaagcttgccaacgttcatttgtcacaatgatgtgggatacagtggatgataatgccgaactgtcgcatgctgttcttaggagagcgcacatgtggtgcagttatcacggcgcagtgccctacttcccacggcagtgcgccctaaccaacatctacgatgtcagctcctgcgaggagcccttggccgctttccaatggttgaagactcgaaaggtcatggatgttcatgacaagtaccgaactgctcgtacgatttcgcctggattttccagtctttttgacgactacgtgccgctacaagaaattttccctctcttggctgacacgctcgccggccttgatggagacatgcctaacgacgacgactcatccagtacccttacacttactgtggagtatcccgaggttgatgagaatggagtgttggttccccaagaaccctcatcacccacgagtttggggctcgactggaccatggcagtggaaaagcacaccgacaacccactttcatgttctttcgacggatcaccatattcatctctagggtgctttccaattggtattgatgcttccaaagcagatttcgatcgcgtcctcaagtcacagcggcatctgcgggatctcaagttgcttagccgtctccctgtggaacagttcagtgccactgctgagacactcagccgctacgcttctagcagcagtcactttctgaaccttgtccctactatgagagaggctatattagctcttgtagaagcattggaccatgctgttgaggatggtgccgacccttaccgattccaagcatattctgcacttgattcaggatttcatactcccaacggcgcctcattttggggagtgtgggaactagaccctcggactaaagctatcatcatatatgtgtccaaatctgtacaggatgtcaaaggagttctgcttcacacatacctgagtatgatgggcttttctaggtaccagtgtttccttgcggaatacggtcttagcgaatttgctgccggatcattttcaccagaacgactaccggatcggctagttcaagatctggatcttctttcgtcctcagagcttctaaattacctgcagcatattcgttattcagaatgggaagaggaatgctcgctgctccctgcgattcgcgaacgctgtaaggagttgttgattgatgtacctacgtatcatcagtttaagcaactgagcaacgtagactacattggcgaaaaagtcaccgacgaggagctagtgaacgcgaaactcaaatggtatcgactctcgcgcgtgccgactcttgatgaggcgcaagctttacaactcttcagacacatcaatgaggtgtttaccagcatactatggtggagggatcaccagaagcttgataccatcacttcagccatcacagacatcaccagccggggaacactcgactcggcggctgactttgtccttttctgtatcttctgtgcagccaggaaagccggattcgaagaagtctacattgaggtctcagacaggaacccactcttcaaccagtattccgatcagagtgcggcattcgcagaactgtttgcgctaggatctcgatgtgaagcttatttcgatatcaagcctagcgacatgggtatcttgctatcggagaaacatagggcgtactacaaccaagaagaacaccagcctccgatgtggatcttcaatgcgccttcatttgcctccgcttatgctgcagcccagacagatatcgaccctgagcagaaggcctccgtcatgcctgcctatcgtcgctttactttcctcagtgtcttcgcaattcctgcccttgtcgatattgtgcttctctccactaccgggcacggcctttacctcagtgtgaggatgactgaagacgacaggtactatgctacgctggcattgatgtgctcattgctgctctctggcgctataggaacttggatctctattggtggcacatactacctcatttccatggcattctccgcagccaacatgtttgtcctcacacgattggttggtggcctggcttttactcttgctggatgtcttcttggatttatcgtcatttcggctgtatcaggacccggtcacggcgccgtcttcttcttctacctctttggactgactacatacctgaccgtcctggctgtgctttccacgtatcagattcctggatccagcttcctcaacggccgaaaaatcatcattatggtcattccaaccttggtgatctcccctattctgaccatcttcattgggatgaagggccatgacatttatctctatctgggtgttttgtatatcttcgttacccttttgattcttggcaccagacgcgtggcaacccaatgggtaacctggtatcacaacatcaagacactcaacgattcggatatcaagaactggtatatgaaattgcactctgaaagggagcaggaagcgaccgccctcaaaaacagaggtcaaagcaagggtccagctatatcaactgtcgcgggcggatccctcgttgcctcctcggaggggtcttttagtgagccagatatcttccagggcatgagcgaaccagccattctggcattgtgccgcaacgctcttcatgaagccgtcctaaaagaacatggacgtcatttctggcagaagtccacaaaagatagcttcgtgaaacaactcgctggctgctgggattcgactttgtttttgctggattggtacgctcgcataacagacaccaagcgaccaattccgtacagttcgacttggaacctcgaaacccaagtcgcgttggagagtatgcaacaatcgcagaaaggaattcgtctccacaattcgttcattcactggcgaacagcaggtgatgaaatctactgcggtatcctttacttcctggtcgcactcatggaccgttggttggacatattgaacgggggccagatagtggatatgccaggagcagatagtcctgttcaattgtcggctggtcttggacttgcatacgactttgcaggtgagatggacacggcgctccgcctatcagtcggttttggactcgcgtactacctgattggagctgtcctactcgactacaaggctcagcatctacacaccctgtcggagcagatggcacccatctcaattgaaaacacgcaacagatcaaacaagccaaggctaacgatctgaaattcaggcgtcatctctacttcaataccttgtgtcgcttcatcggcgtccatgtgtgggcgcttgctttctgcactgccctcatctggatcttcaatagctcgtccattgggctgaccctgttcctgtcctacgttggtgcttacactggactcttgctgtatcagtacaacaagatcttctctggcccgcacgcactcatgccattgctagcagctgttgtggttggtttgatagtaggcaacgtactcttggcggtcttccctggtttcctctatgacaggattatcgctcttgccgcgtcaacttggacagcagcccttctttcattccgaactgccaaactaggcatgccagaagctctagacttcagcaaatgggtctcggagtcattttcatcagccaagcgttccaaaaaggcagcaaacactgtgaatgcacaacctgatgatggaacagagtcaccaatgagcgacaagttccacgcctacaacagcggcaacagcgattccgaatacagtcaaagcgagctccgcgcatactgcaacatgattcgagctgctgcaaaagagaacagataccgtgtcaatccagttggtcaacccggtgatcaaatcgttgcgttgctgctatcatgcactcacgatagtctttcaaggcaagctttacaagctttcccggccatgccatcaacaattcagcgaatcgtgtcggcttggagaaatgggcaaatcgatgtcttcattgtccctctccaggcggtcgtcaacttcaataacgatcttcgtgccatttcgcactttgccgacggtcatttgacgctgtatataacgtcggatgcgaagggcccaggctttggccaaacgaacgtgagcagcaactgcactgctattgccgaaactttacttcatgcgtgcatggaaacattcctcgagaccccgcactcacaagctgagattgcggaatccattcttgcatgcagggagaacgacggtgagcagtatgctatctcagagtgcaacagacgctcgatgccggcattggttgctgggcaagacgctttgtcgtatggaaaggcctgccgcagagaacttttgcgaaatttgtgccttggattcgactgtgaaacgcagtgggatagcttgccattggacatacgacgactgtttttccgacgttgtctcggcatccgagcaccttacacgaacaaggaactatcctggatccacgaaaacatccgcaccgaagagtcctgtgcaattctctcagtcatcgcacgctatgatctaggagcctacttggcagttgtcaagtacagctactttaggaatcgaggcgatcaatcactctccaacaaagaatatcgtcaagtcactgcggatatccaaacggcgtatcatccggtcctcaatcgctccgccgtttcgatgtttagcttgttcactgaatacatccgccttccggttgcttatgtgtatcactgtgctggaacctgggtaaagttctttgttctggcgtgtatggccgatcccgagtatcagcgtgagctgaacggggcactactgcacaaaccgtggatcgttgccaagccaactacatttcttctcacgggactgtggatatacagccgacgtgcaatgtccatagctctgccgttcttcctctaccatcgtcgtaaagatattgcaggcctagcaggaaccgtcaagggaagtttgatcatccagagaaagaaccgcttggtcattcaaagtgccggagagactgagacggctttcgtccaccctgacaaagacggcggcttcaagttgatcttctattcaggcgctctcaaaaccgagccgacttggggtcagattcgtgtttctcactacgataaagagatgcgcatcaagctacgacaagagtggaagaatggctcagtcaccaatgagtttacttacgaatatgaaacgaaccaaacgcaaagcaagatcaagatttccaaagtacggtcaaccaagatccccctcagccggatttgcggcaaaggcgaaaacgacggagcaaaggtcttgtacaaccacaaaggccatattgaatctggaagttacatcagccacaacaaccttgtacgcttcaaataccactaccgaaagaacgccaagtacgacgatgaactccttcgtgccgagttcgtgcttccacatatgtcggccaatgtcagctggtgcgcgcctcctgttcgccatgccgagaagacggagcgttggatacctaccccacgtgtgcatgaagcgaccttcgtccaaggtgccgacgtttacgaatgcacatggttttatgatcacaagttccacccaacgattacaaccaagctcaacggcataatggttgatacaccagacatgatccgtcacgattggcttggtgttctcaagaagcccacccgctgcactttcgctgatgaaaaccctctactggcattcaaaactccgacctcgaacttcttgggccggttgttccgaaggaacatcaagcagcaagagatctctacttcgagagctcgatctcatctctggaaggcttggaagaagcgtaatgaccttgatggagtcgtcattcgctgggtcgacgaggaactgatccggaaggaggctctgctaagaccttactggagacgccgtgatcgtggaagtctggtcaaagcagaagactaccttgccctacacgccgatgccatcatggccagctcagatctcactagcgatatcagcgcgtggacccctctagccatccgcatgagcgacctgttcagtttcggtcaaggtggagatgctgtcgttttcaccaggactaaggcactgcaacgcgataccgataactcactacacgtcattgctgtcgacactggaacctggccaaacgaaggtggtggtgtctcagcatgtcgccgagatctcatcaacaaccttcgcactatcaaatggcacatggtcgtggaatcagctaacgactttggactgccaaagcatcagactgaggagaacgtcgaatccctgaagatcattcccctatggggcctggactttatgcatcccaaccacggcatgttcaccaacaagctggacagcgaggttgaccatctcgtcaaggcagcaactttgactgacattgagacaaacttcattcctacgctgaccgctcttgtccgcggagcgcgagctactaccatgacttctgcagatgtcaagcaggcaacacgtgctttggttaacctcaacacatacttccaagattcgcgccactggaaagaggtttggactagcgacatcgtcaaagactcttggaggaagctgtggctgacagacgacatgccgaatgcccaaccggcaaaggattggttccgtaccgagttgccaacacttggccactttgacactgctttggaactgtggtataggtgtaagtagaagctgccagcgtacattgagtgaaactaacatttacagatctcttcatcttctccattccgatccccgacaagatcccgcatgttttccaagcctctcaccacagtgtctctgcgtcttatggtatcgtttgcaagctcaagcgcaactgtactctccagatctgggaccatgccatctcctggcgtgagactaacctctatttgtcatcggccatgtgcactctaccaccctttatccgaaactcgctgctaggcctgatgaagctgacctcgtgtctcattcttcatcacgccgatcagatccttccatgtgcaggtacgtatatatatcccttgagtttgtcgctctcaactaactcctttctctcagacttcttcaacccaggatgggagattgaaattggaagcgcaaaaggacagctcacacatcgcaacgtcttcaagcgcaaggtcgatcctattgtcaacggtatcactgatatgacaaagttcgctccagtcacggagatcaaggcaaagacaccaactgtgaccatgttgtcccacgtctggtttgccaaggacatcaagacggctctgctggccgccgacattattacaaacgagtggggtttcaaagactataagcttgacatttacggtgctctcaacaaatctcctgtctactcttccgagtgtcaagagattctcgcctgtaagggtctgggccagaacgtcaccatgcgcggtacagcggatccagcaatggttcttgcaaacacctggctgttcctcaactcatcggtttccgaaggtctgcctctcgcacttggagaagctgcgttgactggagcccctgttgtctgcactgatgtgggtgcgtctttgcgcgtgctcaccgatcccgatgatggaaaacgttacagcgaagttgttgctccaaacgatgcatacggcctggctcgcgcccagatcaatctcctcgccatgctagacgaatgggcacagtatgccgaagacggccctggtgtcgctgctccagtcctcccccacaagcccacacccaaagacgtcgaaatcatcacccgccgcatgtacgagaaatccgaccaccgccgcaaactcggcatgatggcccgtaacattgtccaaaagtcgtttggcggcgagcgctacctccgcgagcacgagcaaatgctctggattggcaagtccttctacgaaatgctcgactttgaaaagcaaacccctccgccccgaaacccagcgcgcatgttgtcgcttggccgcacccgcaccgtgccgcagcgcgacaccatggacacaacctcgagcagcatcttcgatccgcaaatggaaaagatgatgcatccccgtcgtccttttgctcaacatcgcgcttcggctgctacgtccttttcgtccgtctacattgacgacgaagatgactcgggcccttcatcccgctactcgcccgaccttccctgggaatctgaagcctgggacacgcagcccggctcggctggcgcaagcacaaagtacgctacctctgagagcgacgagtgggctctccctgttatcccgcgcccgactcgaacgtactctggcacgcacattgcgccgatgcgtacaccgtcgtcgtcggtggctcccgccaagggcaagcgccccatgcagttccagtacgcgggctccatggctagagaggacactggtaatggcatgttggatccccgccgcgatgtcctggcacgacagagctgggcgcctaatagtggacggagtagtttgaggaggagtcatttgaatgagatggaactcgcctaa

SEQ ID NO: 99 - protein, 2467 aa, Botrytis cinerea
MLARTFVALCSVLLSTQVDALRYEEEFVGYNLNTNQTATSPFDYYGKWEDHEFFQSPDNWRFPFYSFFLDKFVNGDPTNDDINGTKFETDFMQTQLRHGGDLQGLIDSLDYIQGMGIKGIYIAGSPMINAPWGADQYSPLDFSLLDQHFGDIDLWRKTTTAIHDRGMYVMLDNTMGTMGDLIAFKGYENSSTPFTLTEHEVLWRNDNRQYLDFSFGSKYNETCNYPRFWLDTGYTVKEDVTDLMNGCYDSEFDQYGDTEAFGVFPDWQRQLSKFASVQDRLREWVPSVRTKIEIFTCMIIQQLDIDGLRVDKATQITVDALGSFSHAIRECARDVNKTNFMVTGEITGGNTFGSIYLGRGRQPDMLPSSMADAVKLTSNSSLAYFIRDHDQNALDSAAFHYSVYRTLTRFLGMDGNLASGYDTPTNWVDAWNEMLVTNDFVNPNTGVFDPRHMYGVSNQDVFRWPAIQNGTQKQLLGFFITTIHMPGIPLLLWGEEQAFYVLDNTADNYLFGRQAMSPSQAWQTHGCYALGSGTYYQFPNDSCTRGCNDDWNSRDHRDPSHPVRNIVKAMYQMRDNYPVLTDGAFLRQLSNQTIEILLPGSNGTATETGMWSTMRGQYDGIQDLSKAGGQANQSVWMVYHNNYDTVTYSFDCSSNETSLVAPFLDGVTVKNLFYPYEEVTLKAGPFQLGIANQTGFNGCLDSLTLVPYEYKAYVPKKSWVGPSPMITSFSPGHDARLVSTVAPGEQETIEIEFGFSAEMKCSDLISKMVITSATEDGQVATLANATGEYSCTLLPSAVNVTEFVGSIPTMWTFKGNLTNVSNGVHSITLANITSNSGNSSTGATDTFLFRVGQVDNPIAFPGSANFTRELLHKYDNGTLYVSHKAAGADRFKYSLNWGSSWSEWLPYVGGNTTLEPQAWTGTSKQKWDGDHVIMQYWSKLTGSSDVVQHADLETNKWSRRLPHLFANGPYNQYGYDTGIDNGFTLNKKDSLWEYKFMTEWPAVMQVNVWGMNPDGQPDETIVLGDIDNDNILDRMPPSSLSTALINITRVPPSPYLGYKIAIDDGNYRYYQIPYGNRSYQMLMVVLFWIVPVLSGGLSIWLFMKSFYAVKLNSVGVKEAKNYIPLALRRKLKREKKEDPSEKEMTVMGGLHSMFHENATQLGLQADVAATGRRTVLIATMEYDIEDWAIKIKIGGLGVMAQLMGKNLGHQDLIWVVPCVGGIDYPIDHQAEPMDVTILGNSYTVQVQYHTLRNITYVLLDAPVFRAQSKSEPYPARMDDLDSAVYYSAWNQCIALTIKRFPVDLYHINDYHGAVAPVHLLPETIPCCLSLHNAEFQGLWPMRNQKERSEVCQVYNIPEEVAIKYVQFGDVFNLLHAGSSYLRIHQKGFGAVGVSKKYGKRSWARYPIFWGLSKIGNLPNPDPSDTGDWNGTQDSTGKTIVNQDFESQRADLKRQAQEWAGLEQNPKAELLVFVGRWSMQKGIDLIADVMPAVLEENPNVQLICVGPVIDLYGKFAALKLDVMMTKYKGRVFSKPEFTALPPFIFSGAEFALIPSRDEPFGLVAVEFGRKGALGIGARVGGLGQMPGWWFTVESTTTTHMLHQFKQAIKEALASKLETRQIMRARSAKQRFPVAQWVNDLEILQSKAIKIHDKEEAKHSGRPRSRGRDGGNIFYSSAKRLSSFGTSFASTSQLDVASTIGGSTRPSSPTRVEQPPAGGGLSRKLSLGYRAGPGHRVTKNRFNGSNAPGAGIKNDEGLTDVDEDSDDEDARIRDDIYDEYVLTPEELEAQRQQEQWRGQAESPAAGGAFLAPQPGFLDSPRRSPSANTGSLHINDSELSLPRLKDGSNIYSTHSIPGSPGLESPGTPGAHDSLLPPPSIFGAGGDNANRASMLSLSSVIGDKTDFKLQKVDPFFTDTQGEYYQQFARNLDNLDGKNSEGQLCIEEYLIKSEKKWFDRFRDAKLGRNSVAPSFSALGSGRRSHDSRGRSNSRDSFTNDTITHSRQNSSQDNMALTGGSTANDQFLLGKDYKPPTGLRLVMQYRFFDWPVYSFLLAFGQIIAANSYQITLLTGTVGQSAEKLYITATIYLVTSIMWWEVFSFFKSIYVLSIPFIFYGLAFFLLGMAPFVDGADGRGWVQNVATGLYAVAASSGSIFFALNFGDEGGSPVKAWVFRACIIQGTQQAYVVILWFWGSYLNRRQADGLGTSFTSASPKMSAVVLPIAVLMWAVGLITFLGLPEYYRQAPGKVPSFYASLFRRKIVMWFFVTVLIQNFFLSTLYGRNWLYLFSSNHAPTWAIILLIIFFFGFLWAGFLWFFAILSKDHSWVLPIFAIGLGAPRWCQMLWSCTPIGQYVPWVGGGLASAIFSRSLWLWLGMLDALQGVGFGMLLLQTLTRVHIAFTLIAAQVLGSIATMVARACAPNKIGPGTVFPDFSDGAAGLGNGWFWIGLILQLVICGGFFTFFRKEQLSKP

SEQ ID NO: 100 - DNA, 7548 bp, Botrytis cinerea
atgctcgcgcgaactttcgttgccttgtgcagcgtcttgttgagtacacaggtcgatgctttacgttacgaagaggagtttgtgggctacaatctgaatacaaatcagacggcaacatcaccttttgattactatggaaaatgggaagatgtacgtgaaaattcgtggctcttggagcgttaaaaactccagtggtgaatttttgaatatccagatgtacattggctgacctatcttttcgtagcacgaattttttcaatctccagataattggcgttttcccttctactctttctttctggataaattcgtgaatggagatccaacgaacgacgatatcaatggaaccaaattcgaaactgatttcatgcaaacccaattacgacatggaggagatctacagggtctcattgatagtctggactatatacaaggaatgggaataaagggaatttatattgctggaagtcctatgatcaatgcgccttggggcgctgatcaatactctcctctggatttcagtcttctcgaccaacatttcggagatatcgatttgtggaggaaaactaccactgccatccatgacaggggaatgtatgtgatgctcgacaacaccatgggaaccatgggagacttgattgctttcaaaggctatgaaaattcttcgactccgttcaccctgaccgagcacgaagtcctttggcgtaatgacaaccgccaatatctggatttttccttcgggtcgaagtacaatgagacctgcaactaccctagattctggcttgatactggatataccgtcaaggaagatgtcactgacctcatgaatgggtgctatgattccgaattcgatcaatatggtgataccgaagcttttggtgtcttccctgattggcaacgtcagttgtcaaagttcgcctctgtccaggatcgtttgagagaatgggttccatccgtaagaactaaaatcgagatcttcacttgcatgatcatccaacaattggacattgatggactgcgtgtggacaaggcgacacaaattacggtcgatgcattgggaagtttcagtcacgcaatcagagagtgcgcaagagatgtgaacaagacaaatttcatggttactggtgaaatcactggtggaaacacttttggaagtatttacctcgggcgtggacgtcaacctgacatgttaccgtccagcatggcagatgcggttaaattgacctccaattctagtctggcatattttatccgtgatcacgatcaaaacgcgctcgactctgctgcttttcactatagtgtttatcgcacactgaccagatttctgggaatggacggaaacttggcaagtggttatgatacaccaactaactgggtagatgcgtggaacgaaatgcttgtaacgaacgattttgttaaccctaatactggagtgttcgatccaagacatatgtacggagtcagcaatcaggatgttttcagatggccagctatccagaatggcacacaaaaacaacttctagggttcttcatcacgactatacacatgcctggtattcctttgcttttgtggggtgaagaacaagcattctatgtcttagacaatacagccgacaattatctcttcggtcgacaagctatgtctccttctcaagcatggcagactcacggatgctacgcccttggcagtggtacatattatcaattccccaatgactcttgcactcgaggttgcaatgatgattggaacagccgcgatcacagagatccatctcatccagttagaaatattgtcaaggcaatgtaccagatgcgagacaactatccagttttgaccgatggagcatttttacgacaactttccaaccagacaatcgaaatcctcttaccaggtagtaacggaacagctactgaaactggaatgtggagtaccatgcgaggtcaatacgatggtattcaagatttatctaaagctggtggtcaagcaaaccagtctgtttggatggtttaccacaacaattatgacacagttacatattcttttgattgcagtagcaacgaaacctcgcttgttgctcctttccttgacggtgtcactgtcaaaaatttgttctatccgtatgaggaggttacattgaaagcaggtccttttcagctaggaattgcaaatcagactggcttcaatggctgtctcgatagtctcactctcgttccatacgagtataaagcgtatgtgccaaaaaagagctgggttggaccttcgcctatgattacctcattttcaccaggacacgatgcacgacttgtttctacagttgctcccggagaacaagaaaccattgaaattgaatttggcttcagtgccgaaatgaagtgctctgatctcatttcgaaaatggtaattacctcggcaacagaagacggacaggttgcaacactagccaatgccaccggtgaatattcttgtactttgcttccaagtgcggtcaatgtaaccgaattcgtcggatcaattccaaccatgtggactttcaaaggaaatcttaccaatgtatccaacggtgtccactcaatcactctagccaatatcaccagcaactctggaaattcctcaactggagccacagatacattcttgttccgtgttggacaagttgataatcctatcgctttccccggttccgcaaacttcacaagagaattacttcacaagtatgacaatggcacattgtatgtcagccacaaagctgctggagcagatcggttcaaatattctttgaactggggaagttcatggtctgaatggttaccatatgttggtggaaataccacacttgaaccacaggcttggactggtacaagcaaacaaaaatgggacggagatcacgtcatcatgcaatattggagcaaacttactggtagcagtgatgtagttcaacatgctgatctagaaaccaacaaatggtcgcgtcgccttccgcacttgtttgctaatggtccatacaaccagtatggatatgatactggtatcgataatggtttcactttgaacaagaaagacagtctctgggaatataagtttatgactgaatggccagccggtaagttgtatcttcaatccgatgtatcaaggcactctaacaatttctagtcatgcaagtgaatgtttggggtatgaatcctgatgggcaacctgacgaaactatcgtgttgggagatatcgacaatgataatatccttgatcgtatgccaccttcatcgctatccacggcgctcatcaacatcacacgcgtgccaccatcaccatatctcggatacaaaattgcaatcgacgacggtaattatagatactatcaaatcccttacggaaatcgttcctaccaaatgttgatggttgtccttttctggattgtccctgtactcagtggtggtctcagtatctggctgttcatgaaatctttctacgccgtcaaactcaacagtgtcggtgtcaaggaggcaaagaactatatcccattagccttgcgcagaaagctgaagagagaaaagaaagaggacccatctgagaaagaaatgaccgtcatgggaggattgcactcaatgttccacgaaaatgccacacaacttggactgcaggctgatgttgcagcgaccggacgacgaactgtacttattgctactatggaatatgatattgaagattgggctatcaagatcaagattggtggtcttggtgtcatggcacaattgatgggaaagaatttgggtcatcaagatctcatttgggtcgttccttgtgttggtggtatcgattatcctatcgatcaccaagctgaacctatggatgtcacaattcttggaaattcctacactgttcaagttcagtaccatactctacgaaacatcacttacgttcttctcgatgcaccagttttcagagcacaatctaagtctgagccatacccagctcgtatggatgatttagactcggccgtttactacagtgcttggaatcaatgtatcgctcttaccatcaagcgtttccccgtcgatttgtatcacatcaacgattaccacggagccgttgcaccagtccatcttcttccagaaacgattccatgttgtttgtccctccacaacgccgagttccaagggttatggcccatgcgtaaccagaaagagagaagtgaagtctgtcaagtctacaacattccagaagaagtcgccatcaaatacgttcaattcggagatgtgttcaatttgctccacgccggaagttcttatcttcgtattcatcaaaagggtttcggtgctgttggtgtcagtaagaaatacggaaagcgttcctgggcaagatatcctattttctggggattgagcaagatcggcaatcttcctaatcctgatccttctgatactggagactggaatggtactcaagattcaacgggcaagacaattgttaaccaggattttgaaagtcaaagagccgacctcaaaagacaagcacaggaatgggccggtctcgaacaaaatcctaaagccgaacttttggttttcgtcggtagatggtcgatgcaaaagggtattgatttgattgctgatgttatgcctgctgttttggaggagaatccaaatgttcaacttatttgcgttggtcctgttattgatctttatggaaaattcgccgctctcaaactcgatgtcatgatgacaaaatacaagggccgtgtcttcagtaagcctgagttcactgctcttccaccattcattttctcgggagccgaattcgccttgattccatctagagatgaacctttcggtcttgtcgctgtagagtttggtagaaaaggagctttgggtattggtgctcgtgttggtggtcttggtcaaatgcctggttggtggttcactgtcgaatctactacgacaacccatatgcttcatcaattcaaacaagccattaaggaagccttggcctccaaattggaaactcgtcaaataatgagagcacgatctgcaaagcaacgtttcccagtcgctcaatgggtcaatgatcttgagatattgcaaagtaaagcaatcaagattcacgataaggaagaggccaaacattctggtagaccaagatctagaggaagagatggaggaaatattttctattcttccgctaagagattatcgagttttggtaccagttttgctagtacctcacaacttgatgttgccagtaccattggtggctctaccagaccatcatcgccaactcgtgttgaacagccaccggcaggaggtggactgagccgaaagctttctttgggatacagagctggcccgggacatcgcgtaacgaaaaatagattcaatggcagtaatgcaccgggtgctggaatcaaaaatgacgaaggacttaccgatgtggatgaggacagcgatgatgaagatgcccgaattcgtgacgacatatacgatgaatacgtactcacccctgaagaactagaagcacagagacaacaagagcaatggagaggacaagctgaaagtcccgcagcaggaggcgcattcctcgcaccacaaccaggattcttggattctccacgcagaagtccaagtgccaatactggtagtttgcatatcaacgattccgaactgtcgttgccacgtctcaaggatggctcaaatatttattccacccactcgatacctggctctcctggtttagagtcacctggaactccgggagcacacgattctttgcttcctcctccatcaatctttggagccggtggtgacaacgcaaacagagcttccatgcttagtttgagttccgttatcggagacaagacagatttcaaacttcaaaaggtcgatccattcttcactgatactcaaggagaatactatcaacaatttgccaggaatcttgataatctggatggaaagaacagtgaaggacaattgtgtatcgaggaatatctgatcaaatctgaaaagaaatggtttgacaggttccgtgatgcaaaattgggaagaaactcagttgcaccttcgttctctgcccttggaagtggacgaagatctcacgatagccgtggacgatccaacagtcgggatagctttaccaacgataccattacccactcaaggcaaaattctagtcaagataacatggcactcactggcggatctactgccaatgatcaattcttacttggcaaagattataaaccacctactggtcttcgtctggtcatgcaataccgcttctttgattggcctgtctactcattcttactcgccttcggtcaaatcatcgcagctaattcttatcaaatcactcttcttaccggtactgtgggtcaaagtgcagagaaactttacatcacagcaacgatctatcttgttacctcgatcatgtggtgggaagtcttttccttcttcaaatcaatctacgtcctcagtattccattcatcttttacggattggcctttttcctcctcggcatggctcctttcgtagacggtgctgatggaaggggttgggtccagaacgtagctactggtttgtatgctgttgccgcttcatcgggtagtattttcttcgctttgaatttcggagatgaaggaggatctcctgtgaaagcctgggttttccgcgcctgcatcattcaaggaacacaacaagcttatgtcgtcattctctggttctggggatcttatctcaacagacgtcaagctgatggtcttggaacttccttcacatctgctagtcccaaaatgtctgcagtcgttcttcctattgccgtactcatgtgggcggttggtctcatcactttcctcggattgccagaatattatcgacaagcgcctggaaaagtaccatctttctacgcctcgctcttcagacgtaagattgtcatgtggtttttcgtcactgttttgattcagaacttcttcctctcgacgctctatggtcgtaactggctttatctattctcctctaaccatgctcctacatgggccatcatccttctcatcatcttcttctttggattcttatgggcaggcttcctctggttcttcgcaatcttgagtaaagatcacagttgggttctaccaattttcgccattggtctcggagctcctagatggtgtcaaatgctctggtcttgcacaccgataggacaatacgtaccatgggttggcggtgggcttgccagtgctatcttctctcgatcattgtggctttggctcggtatgctcgatgcacttcaaggtgtgggattcggtatgctgttgcttcaaactcttactcgtgttcatattgctttcactctcatcgcggctcaagttttgggttcaatagctactatggtagccagagcatgtgcaccaaataaaattggacctggaactgtcttccctgattttagtgacggggcggctggacttggaaatgggtggttttggatcgggttgattttacaactcgttatttgcggtggatttttcacattcttcagaaaagagcaacttagcaagccttag

SEQ ID NO: 101 - protein, 436 aa, Botrytis cinerea
MPGSTNSSSDSGASTPERLSFDNENSAVGTPLTEKSLLFDVDDIDFAVRNAVREAVNDQWILVVGGLGFIGSHTVWELAKAGYNVAIIDNLSNSFFTVFEKLQLMVDQHYSAPRKNGHRPLLKFHDADFRDMNKMTAILEKYDYPGVMSFDSSSVTLCNGQRSSISGVIHFAAYKAVEESIQHPLKYYSNNVGGLVDFCALLQQFGIKKMVFSSSATVYGTVADTGVPLREEYVVGSGCSGLTNPYGRTKWMCEAILSDLANSDPDWEITALRYFNPIGCDESGLLGEDPRAAATNLMPVVLRVLTGALPALNVYGSDYDTHDGTAVRDYIHVTDLARGHLAALSNRPSGGFKVYNLGTGQGYSVLDVVNAMEKATQTKIPTNIVGRRGGDVGKCVALANKAEEELMWKTEKSLEDCCNDLWRFLEGTSITKAQAC

SEQ ID NO: 102 - DNA, 1361 bp, Botrytis cinerea
atgcctggctcgacaaattcttcctcagattcgggagcttccactcctgaacgactctcctttgacaacgaaaacagtgctgttggaactcccttgaccgaaaaatccttattattcgacgtcgacgatatcgattttgcagttagaaatgcagttagagaagcagttaacgatcaatggatattggtcgtcggtggtttgggattcataggtagtcacacagtctgggaactagccaaagctgggtacaatgtaatgatatcacccacaaatttgcgggtaatcgctaacaattgttataggtggccataatcgacaacctcagcaattcgttttttaccgtcttcgaaaagctccagttgatggtcgatcagcattacagtgctccgcgcaaaaatggacaccgaccattactcaaatttcacgatgcggatttcagagacatgaacaaaatgacagcgatactcgaaaaatatgactatcccggggtgatgagtttcgattcgagttccgttactctttgcaatggtcagagatcaagcatatccggcgtcatacacttcgccgcgtacaaggccgtcgaagagagcatacaacaccccctcaaatactattcaaacaatgttggcgggctggtcgatttctgcgctctgctgcagcaatttgggatcaagaagatggtgttcagttcttctgcgaccgtttatggaaccgttgcagatactggggtgccacttcgcgaagaatatgtggtggggtcaggatgctcgggtctcacaaatccctacggacgcacaaagtggatgtgcgaagcaatcttgagcgatctcgccaattctgatccggattgggagatcactgcactgcgctacttcaacccgatcggatgcgatgaatcgggcttgctgggcgaagaccctcgggctgccgcgacaaatctgatgcccgtcgtcttgcgggtgcttacgggcgctttgcctgcgctaaacgtgtatggtagtgattatgatacccacgatggcaccgccgtgcgagactacatccacgttaccgatcttgcgcgcggccatctggcagctctcagcaatcggccaagcggtggcttcaaggtctataacctgggtactggccaaggatactcggtcctggacgtcgtgaacgcaatggagaaggccactcaaaccaaaatccccaccaatattgttggcaggagaggaggagatgtcggcaagtgtgtagcactggcgaacaaggcggaggaggagttaatgtggaagacggagaaaagtctggaagattgttgtaatgatctgtggcgtttcttagaaggcacctcaatcaccaaagcacaagcatgttga

SEQ ID NO: 103 - protein, 253 aa, Botrytis cinerea
MFFKKKASVIPAKSKVLVPLYIYPSPGAISTYPGLEFIVVVNPHNGPGQLLDSNYRREIQTLNSYPNVTVVGYVSTAYATRQYSSVLEDVTTYATWRLEDAGLGVRGIFFDETPSQWSASNASFLANINAAVKGNSGLGAEPLVIHNPGTIPHKKLISGPCLPDINVVFEATHKTYRENACEKALTDLKMDPGRLACLMHSVPDSLMSTHSDVVSETQKLRSIVGTLYITSQATELYTDLGEHWEQFIHAVSL

SEQ ID NO: 104 - DNA, 902 bp, Botrytis cinerea
atgttcttcaagaagaaggcctcagtgatacctgccaaatccaaggttctcgtccccctctacatttacccttcccctggtgcgtggggacggttacttcaaaggcaagtcggggagagcgacggcatctttgggaatattgatcatgggtctgactgaacaacagcatctctacgtatccgggcctcgaattcatcgtcgtggttaatcctcacaatggccctggacaattacttgatagtaactaccgaagagagatccaaacattgaactcataccctaatgttacagttgtcggttatgtctctactgcatatgcaaccaggcaatattccagtgttctagaagatgtgacaacttacgccacttggaggctcgaagatgctgggctcggcgttcgaggcatatttttcgatgaaactccgagccaatggtccgcgtcaaacgcttcatttttggcaaatattaacgctgcagtaaaaggcaattctggtctaggagcagagcctcttgtgcgtgcattttccaatatgttctattactactactgactgattgtcatcgagcaggtcattcacaatccaggaacaattcctcacaagaaattgatatctggtccatgtttaccagatatcaatgtggtgtttgaagcaactcacaagacatatcgtgaaaacgcttgcgagaaagctctcacggatctcaagatggacccagggcgtttggcgtgcttgatgcactctgtaccggattctctgatgtccacgcattccgacgttgtatccgagacacagaagctgagatcgattgtggggacattatatatcactagtcaggcaacagaactttataccgatttgggggagcattgggaacaattcatccatgctgttagtctctaa

SEQ ID NO: 105 - protein, 340 aa, Botrytis cinerea
MSSGGIFKTPLTSSEIAINTPPMASKEQKPVNPHKIFTRKCNIILGLIALFLLAIALALGLTFGLRHHHSSPPASTPTTTPSNPYPPTNASYWTPNLNASNTWNIELLAALDPANIYANTTIYDIDLFLAANTTPPIIRTLHSQSHKVICYFSAGTIETYRPDTNRFLPSDYGKQLPDWPNEYWANISSPNVRSIMQTRLDLAVNQSCDAVDPDNVDGYSNDNGLKLTEDDSIDYMQWLAAEAHGRGLGIGLKNAGEIIDRVLDNVQFAVNEQCVQYQECDTWQAFIDNGKPVFNIEYPKDAPKVSEAEKTRVCDGSDIHADGFFTIIKKMELDDWVERC

SEQ ID NO: 106 - DNA, 1023 bp, Botrytis cinerea
atgtcctcaggaggaatattcaaaacacctctcacgagcagcgagatcgccatcaacacaccacccatggcttccaaagaacagaaacctgttaatccacacaagattttcaccaggaaatgcaacatcattcttggtctgatcgcgctctttctcctggcaatagccttggctctgggtctgacattcggtctacgacatcaccattcctcccctccagcatccactcctactactacaccatcgaacccgtaccctcctaccaacgcctcatattggaccccaaatctcaacgcttccaatacatggaacatcgagttattagcggcgctcgatcccgccaacatctatgcgaatacaacaatctatgacatcgatctcttccttgcggccaataccaccccccctataatccgtaccttacattcgcaatcccacaaagtaatttgttatttttcagccggcaccatcgaaacataccgtcctgacacgaatcgcttccttccttccgattatggcaagcagcttcccgactggccaaacgaatattgggctaacatttcctcaccaaatgtgcgatccatcatgcaaacacgcttggatttggcggtcaatcaatcatgcgatgcggtcgatcccgacaacgttgatgggtattccaatgacaacgggctcaaactaacagaagatgactctattgattatatgcagtggttggcggctgaggcccatggacggggtttagggattggtctgaagaatgctggcgagattatcgatcgtgtattggacaacgtgcagtttgctgtcaacgagcagtgcgtgcagtaccaggagtgtgacacctggcaggcattcattgacaatggtaagcccgtattcaatatcgagtacccaaaagatgcaccgaaggttagtgaagcggaaaaaacaagagtttgtgatggctcagacatacatgcggatggctttttcaccatcatcaaaaagatggagctggatgactgggtagagcgctgctga

SEQ ID NO: 107 - protein, 722 aa, Botrytis cinerea
MVLLYHLVTHILPLSLFLDAALGHRAHRRNPAEADNLPQSESVAVTNPQAIMTSTVPAAPLATVSIGTLAVLANTTVATPPLAELIATDAVDTVSSKVLVIARDSVSAYSAWSGLNDRGIPYETLIVPAAGVALPTLNSSETHGNYGLIVVMSELSYSYPDLGYQSAITADQWQAIYNYQTAFRVRLVRLDSYPSAAFGTEALGACCNDGVEQLVHISDNSAFPKAGLKTGATMSTKGIYHYPTQITNSTLAKEFLQLGASSDGQFTTASTAGVINNINGREQMVFYVPFSTDWAVTSVWLQHAWIDWGTRSLYTGYRRALLSTQIDDMFLESDIYSPAGSTYRIGTADLAQHITFMGSVNSKLNAGSNWFIEVGHNGNGNVEKSDEINASESVCSPGPIEYGEQIDTPLEWVKPLGTGTDIWPKTSVLYPNYTTACLSDDSLLTWWITPSNLNAFAHISHTFTHEDQNNATYADVYREMTWNQAWLTATGFANAEKFSPQGLIPPAITGLHNGDALRAWADSGITHAVGDNTRAALLNTENEHWPLFTTVEANGYAGIQVTPRWATNIYYNCDMPDCTVLEWINTSAGSGDINTLLEVEKQTNVRHLLGLHHDAFMVDWPLITHKHDDLAAIFVNRMTRDSCGASLSYQLDTTSSSITGFTLSANGNTCSTPLPVTLPGSVTDTQGATVEQIGNDPTTLWVTLSGAPVSFTLTTPIPITSS

SEQ ID NO: 108 - DNA, 2797 bp, Botrytis cinerea
atggtgttattgtaccacctcgttacccatattctccctctgagcttgttcctagatgcagctcttggccatcgggctcatcgccgaaatcccgctgaggcggataatctccctcaatcagaatcagttgcggttaccaaccctcaggctattatgacctcgacagttcctgccgcacctctcgctacggtatccattggaacgctagctgtccttgccaatactactgttgctaccccccctctagcagagcttattgctactgatgcagttgatactgtcagcagtaaagttcttgtcattgcacgagattcagtctccgcatactctgcttggagtgggctcaatgatcgaggaatcccatatgaaaccttgatcgtccctgcagctggtgtagcactaccaaccttgaacagttcagaaacccacggaaattatggactcattgttgttatgtcagaactgagttactcctaccctgacttgggatatcaaagtgcaattacagccgaccaatggcaagcaatctacaattatcaaaccgcctttcgcgttcgattggtgagacttgattcttatccatccgctgcattcggtacagaggcactaggagcttgttgcaatgatggtgtcgagcagcttgttcacatttccgacaactcagccttccctaaggcgggactcaagaccggtgcgaccatgagtaccaagggcatataccactatcctactcaaatcacaaactcgacgctggcaaaggagtttctacaactaggagcctcttctgatggccaattcactaccgcaagtacagcaggtgtaatcaataatattaatggcagagaacaaatggtgttttacgttccattttccacagattgggctgtcacatctgtatggttgcaacatgcttggatcgactggggtacaagaagtctctacactggatacagaagagcactactcagcacacagattgacgatatgttcttggagtcagatatttattcacctgctgggtcgacttaccgcattggcacggccgacttggctcagcatattacattcatgggttcggttaactctaaattgaatgctggaagtaactggttcattgaagttggacataatggtaatggaaatgtcgaaaaatccgatgaaatcaacgcaagcgaaagtgtatgtactcctttgatcatgtgacccttacttcattctctccgcttttcggtctcgtttgcgttccaatttcagcccaatagatgagcaaaactaacttttgacttcaggtctgttctcctggacccattgagtatggcgaacaaatcgatacaccattggagtgggtcaagccccttggaaccggaaccgatatctggcccaaaacatcggttctttaccccaattataccaccgcatgcttaagcgacgattctctactcacgtggtggatcaccccctctaatcttaatgcctttgcacacatttctcacacgttcacacacgaggatcaaaacaatgcgacttacgccgatgtatatcgagagatgacctggaatcaagcctggcttactgcgaccggatttgccaatgcagaaaagttcagtccacagggacttattccacctgccatcacggggcttcacaatggtgatgcgcttagggcctgggctgacagcggtatcacgcatgcagttggagacaataccagagcggctctcttgaataccgtaagtgttgctgcgtgccgtgttttcggaaaacccctctttctcttgttgcacaaacctttttccacacaaatttcgctaatgtgaacacaggaaaatgagcattggcctttgttcacaacagttgaggccaacggctatgctggtatccaagtgactccaagatgggcaaccaacatttactacaatgtaagttcgacttgatcgagtagaatcgctaaatctgacacaaattagtgcgacatgcctgattgtaccgtgttggaatggatcaacaccagtgccggatccggtgatataaacactctccttgaggttgagaaacagacaaatgtcagacatttgttgggtcttcaccatgatgccttcatgttagtgccacattccgctcttctctccatgagtgtttgctaattttttgaaataggttccatcaagccaattgtaagttatggcccctcctgttgattcttcctcaccacgattcgcttgatgtggtatccaaacaggccaccatgataagcagttactaattcattaatgatgtagtgcgctacacaggagcggcaacgtacactatcaatggagtgacagcgcaactttcgctgctcatggcatgggttgagaccgtgactcaagaattcgtccgattgtgagttttgtttctgcgatgttttcatccgtactgaccgagtatagggttgattggcctcttatcacccacaaacatgacgacgtaagtcctaaggctcctgttaactgtatatcttctaaccggtcatcagcttgctgctatatttgtcaatcgaatgacacgagattcttgtggagctagcttgtcatatcaactcgatactaccagctcatcgatcacaggcttcacactctctgcaaatggcaacacctgctcgacaccgctcccggtcactctcccaggttcagtcactgatacccaaggggccactgtcgagcagattggtaacgaccctacaacactgtgggtcactttgtctggcgcgcctgtcagcttcactttaaccacaccaattcccataacgagcagctaa

SEQ ID NO: 109 - protein, 3007 aa, Botrytis cinerea
MAQITGLEAASWGDLTKDWWQFILIAFILASVGLGLSFISYLAFQSSIEAYRKWKSAKQSVPASIKKYLVKTLSELSHYKVVAVEKKPESFGVYLGGFNHTPTSEDLQVLAQWDLLVVDAFQENVIHVLSSGLYYKPPQVLARLDISLVVPQQCKGSAALEGAIAWVTKLLASSTASGSDCRFSGILISNWYDQLPSPMLIEFITFIHKLGFQTYLETSSPGFLRDPKLAELNEVAGLIIRNGTISSNGDERDAFQMQEMRPTIKAFVSQACLRPFVVCLWETLDDGVNPANAIVRRSYQWSKFYSALSPWIGSNSDLTSTSHGIDQKEPLGAFSWLKEPGVMEAHKKWRLNHTIANEYIPEMTDLAENILGALSIEVDLQPSEKSNQLSFADVDLEMPSATPQVLLDLPRNSSDVNLPGFSSRSLTPAESLLSIHAPNRRFSDGPYSYLNQSPGNPISASPGGSSNDFLGCFPLGVHASRKSFDEILQSQKKLKSLDLLDPIDNNVLKEIGGKLSQFCNQHGMVELSAWHAAIQELANQLCALADDSAPTDFIRVYKGLDSGLQYQNESRYWAVFAFEERTKLDIFMSRNVQDLSGTILHTFLSSRGCPRHESFEAEKGFWQWSTQSDSYLPPRLLNDISSLSPSELLRFLQTLQLSSVKGNGDLIDSIIFACERELLDSTDFIQMKDACSVGYLGNQKSPQDLIALRSKWHVDNNSQHPSEENALYVFNQINDAITIVLKERRLNTLQAITKALIEIMEAKKIDARVDIICLALFSVFRKHAFDEAYVEVTDRNTLFNDQSDQAAAFAELFATGARCESYFDMTPSCFGKLLSDRYRTCHHQPGREPPIWTDADPSTPSAYAAAKIDIGDFKAKGLSGTMRFTFLSVFAIPALLDILLLTSTGKGLYLSGNMSRTAQHSATLALMISLLISGMCGTWITCGGSYYLISMAFSAMNQFIATRIVGGVAFSLAAGLIGLIGLGIKDGIVAGLVFFLYLFALSTYLILLATLANFSYPGTTFQSGRPVILMILPVLFVSPITTIFVPGYDIYIYLSVLYVFIFLLALGTRHTASKWTTWHQNIEKISDKELKEWYIKTHKDGDDRAFDGMTDPAALKISRTAMIEEIRKVRSGFRHNCQDPTVKSLVDSYDATIFLLKWYSGYSGTPLPMPYSSTWNMQIKVALDTLKQMQTGLRLHNAFIHWRQAGDEVGCSLLYFIVALLDKWNSLLAGGRLLGLSAQNTRYRMPVGFALAYYLIGAVLLDLNAAKLHTMTAESQNMLIGDVSSIPDAVDAGVKARRHLYWSMLGRYSLFHVWSLAVASSLLWVFDSTEASTLLFIAYVGAYTGLLFYQYTKIFAGPRSLKPLLIATCVGLPSGQILRHFLPQFEYCDVVALAAATWTAAFLSLYYAGIRAKPVDTMDSEGRIWNKISQDRSFHEFTSPGRELLLSQDELRMTFENLDALNDDEKYEVDPMTHPGLEIKSILHHAVGIFEEIKGSSVDSIPNFALSAFPEVKALLDETITAFESGKIVVECVAMSMFSDEFKDLKAIGCDSSNLMRIIIGCETMDAMDQNSSISLFCQATAEILLHIAAETFQGVSHEDAILLESLLSSVSPSGLLEQTLVPQGLRNFLNFSNPSKADAENVATCFDDEILRHTAIGCNPNIDWEGLPTEIRELILDRCTGQVDALTTDQHSWVRANKLKGLPIATFLARRNFGAFVATEKKRYTLEFAKTAPVESSDKHEKSNIMNLFGKTQTRRLTADLITKQLKWPFSKVYHTIGHCLKLFAIAFVAEPELQRELNYTMKSTPKYMRSIVMFLITGIWSYANFLQGILMPIFLLHGRKNVETLWKQIRGTTVSLKRQRIMIDSTGGSSTAFVRVPDTASITGSHIINNGREGAEAIQESLLSNGICELRQYGGVLKQEPADSAKLERISIYSKDLLLLRREDYVKGVKANVYEYEYDLEKISKQNVMTTRRRYPISRRCVEGSNQFEQVLFNKQGLVQSGSYILDGNLVRFNCHYRQNSNFEDELLRAEFVLPHMFCMVSWAAPPAKRQDKLDTWIPHSQVIEATFVIGPDVYESQWSYDHKYHPTIYTTLNGEPVDTPALIEWDHLGVLKKPTNFAFRHDDHMIGFKSLRSHALPRWLGMNTHQNPVSTSKARSRLWQAWKNNSAYDGVIMRWLDERLLRREPMLRPYYRRRDHGNLRLAEEYLHENADAIMAVIDLDKSISGWAPLAFQIADLYAFGQGGSANARTRSAPDFKSDELHVLATDSGTWPNEGGGVSACRRDMVNNLKAAKWYMISESANDFGVPKHQTQENVQTLKVIPIWGLDFMTPTHGIFRDRLDSEVIHAVRDATKLDIQKNFVPILKALVKGARTSQYSNSDILQSTRALVNLNAYFSQGKHWTGVWNSRIVKNAWRNLWISQDLVSPTPSEGWFQTEIPTIAQLDAALDLWFRYLFIFSLPMPERIPAIFQASHHSVSASYGIVCKITRGSTLQIWDHAISWRETNLYLSSDLCSLPPFVRNSLLGLMKLTSQLTLHHADIILPCADFFNPGWEIEIGSHQGKLEHRNIFKRKIDPVVNGIPPADISKFSPIKETTSPLPTVTMLSHVWYAKDIKTAILAADIIVNVWGFKDYRLDIYGAIDKAPQYSTDCFEILASKSLPGYVNLCGTASPTDVLKKTWVFLNSSISEGLPLALGEAALTGAPVVCTDVGASLRVLTDFNTGDCFSAVVAPNDAQSLARAQINMLGLLDEWAPYANDPQGYKPPSIIDKPSAEEVAIITKRMYEKKGELRALGMRSREIVQKSFGGNRYLREHEQMLWIGKSRYDIKFPSKQPRPTLRPALPSLAVASNMWGQASIPSAIQTRPMRPSIFRGSSPSIMARSMQAASTVVPSPTLERPTSIMGYGSGVKGYQNINDYFAGYRPGDSNASTPDLQFLTPPGIHTPGGNSVRSQSPMRKGASTRLTMLSRGSTSYDTRSESSSLIVPSKRLPGEDSFLRDLDTALGRV

SEQ ID NO: 110 - DNA, 9555 bp, Botrytis cinerea
atggctcaaatcacaggccttgaagctgcctcttggggggacttaacaaaagattggtggcagtttgtaatctttcccatgcgtctggctggctgtttcccctgttaatttttgaacagattctcattgcatttatccttgcttctgttggtcttggcttgagcttcatatcttatcttgccttccagagctcaatagaggcttatcgagtaagtaaaatagcaaagaatatcttcatatcttatcgcagacctcaaaggttcatgtgataaagcttcatggctgtcaacatctatagctaacgttcttctgtatgtagaaatggaaatctgcaaagcaatctgtccccgcgtccatcaagaagtatcttgtcaagactctttctgaactatcacattataaagtcgtcgctgtcgagaagaagcccgaaagctttggagtatacttaggtgggttcaatcatacgccaacaagtgaagacctgcaagtgttagcacaatgggaccttcttgttgtcgatgcctttcaggagaatgtaatccatgttctatcatccgggctttactacaaaccgccacaggtcctggcaagacttgatataagccttgttgtgccgcagcaatgcaaaggttcagcggcgctcgaaggtgctattgcctgggtcaccaagctattagcttcatcaacagcgtcaggtagcgattgccgtttttctgggattttaattagcaattggtatgatcaactaccaagtccaatgctcatcgaattcattaccttcattcataaacttggattccagacctatctcgaaacatcatctcctggatttttacgcgatcctaaattggcagaactgaatgaagtagctggcctgataataagaaatggcacaatatcatcaaatggggacgaacgggatgcatttcagatgcaagagatgaggcccaccatcaaagcttttgtttctcaagcgtgcctccggccattcgttgtctgtttatgggagactctggatgatggggtaaatccagcaaacgccattgtcagaagatcctaccaatggtcaaagttctatagcgcgctatcaccatggattggttcaaattctgatttaacttcaacatctcatggcatagaccaaaaggaaccgttgggagccttttcatggctcaaggagcctggagtcatggaggcacataaaaagtggcgcctgaaccatactgtaagcacatcatccaatatagcactctatccttgatcaccatccaaaaatttactccttggccatccacaccaaactttactaacgctggttcagattgctaatgaatatataccggaaatgacggacctagctgagaacattctgggagcgctctccattgaagtcgacctccagccatcggagaaatctaaccagctctcatttgccgatgtagaccttgaaatgccctctgccactcctcaagtgcttttggacctaccaagaaattcatctgatgttaacctaccgggattttccagtagatctctcacgccggcagaatcacttttatccatccacgcaccgaaccgtagattctccgatggtccatattcgtatctcaatcaatcacctgggaatcccatatcagcgtctcctggtgggtcatccaacgacttccttggatgctttccacttggggttcatgcttccagaaaatcgtttgatgaaatcctccaatcacaaaagaaactcaaatcccttgatcttctcgatccgatcgataataatgtgttgaaagaaattggtggcaaattaagccaattttgtaatcagcacggaatggtggagctttcagcgtggcatgcagcgatacaagaacttgcgaatcagctttgtgccttagctgatgattctgcccccacagacttcatcagagtgtacaagggccttgactcgggattgcagtaccaaaatgaaagtcgctactgggcagtgtttgcgttcgaagagcggactaagcttgacattttcatgtcaagaaatgttcaagatctcagtggaacaatcttgcatacattcttatcaagtcgtggctgtcctcgccacgaatcatttgaggcagagaaaggattttggcagtggtccacacaatcagattcatacctacctccacgattgctcaatgacataagctctctctcgccatcagagctgcttagatttcttcagacattgcagttatcttccgtcaagggcaacggggatttgatcgattcgataatatttgcatgcgaaagagaattactagactccacagactttatccagatgaaagatgcctgttctgtcggttacctagggaatcaaaaatctccacaagatctcatagcattaagatcaaaatggcacgtggacaataactcgcagcatccttctgaggagaatgctctctacgtcttcaaccaaatcaatgatgcaatcactattgtattaaaagaaagaagattgaacacacttcaggctatcacgaaggctctgattgagattatggaggcgaaaaagattgacgcccgtgttgatattatttgccttgctttattttctgtttttcggaagcacgcttttgatgaggcgtatgttgaagtcactgatagaaacaccttgttcaatgatcagagcgaccaggcggctgcatttgcggagctttttgcaacgggagcccgatgcgagtcttactttgacatgacccctagttgtttcggcaaattactatcggatcgttatcggacttgtcatcatcaacctggccgggagcctccaatctggaccgatgctgatccttcaactccctcagcctatgcagctgcaaagattgatatcggagattttaaagccaagggtctttctgggacaatgagatttactttcttgagtgttttcgcgataccagcacttttggatatcctgctattaacaagcactggcaaaggtctctacttgagtggaaatatgagtcgcacagctcagcattctgctacgttggctttgatgatttcccttttaatatcaggcatgtgtggcacatggataacatgcggcggttcttactatctcatttcaatggccttttccgcaatgaaccaattcatagcgacgagaatcgttggcggtgttgctttctcacttgccgctggcttgattggcttgattggtcttggtatcaaagatggtatcgttgcagggctagtattctttttgtacttgtttgcactaagcacctatttgatactgcttgcaactctggccaatttttcttatccaggtaccactttccaatctggacgtccagttatcctcatgattttacctgtcttatttgtttcaccaatcacaacaatttttgttcctggttatgatatctatatctatttgagtgtcttgtatgtctttatatttcttctcgctttgggaactcgacacacagcatctaaatggactacatggcatcaaaatattgaaaagattagtgacaaggaattgaaagaatggtatattaagactcacaaggacggcgatgaccgtgcattcgatggaatgaccgatccggcagccttgaaaatttcaagaactgcaatgattgaagaaataagaaaagtacgaagtggctttcgacataactgtcaggatccaactgtcaaatcgttggtggacagctatgacgcaacaatatttctattgaaatggtactcgggctactcgggaacgccactaccaatgccatattcatcaacttggaacatgcaaattaaggttgctctggatactctcaagcaaatgcaaacaggtcttaggttgcacaatgcttttatccattggcgtcaggctggtgatgaggtgagtaattttctttcaccatataattattaaattgcgaaatgaaatactaaaataaggcaggttggttgtagtcttctctactttatcgtagcacttctcgacaaatggaactcacttcttgccggtggacgtctcctcgggctatcggcgcagaatacaagataccggatgcctgttggctttgctttggcttattacctaattggtgcagttcttctagatctcaatgccgcaaagcttcataccatgacagctgaaagtcagaatatgctgattggcgacgtctcttcaattccagacgcagtcgacgcaggtgtcaaggcacggagacacctttattggagtatgctgggacggtactcattatttcatgtttggagtttagctgtagcctctagtcttctctgggtatttgacagcacagaggcttcaacccttctttttattgcttatgttggagcctatacaggtaagcaccatttccatgatttgaaacgtttgttaataagtatccacaggtttactattctatcaggtacatttccttgtcaagaaccttgacaaaaatttttaaatctacatcagctaaactctcatctagtacacaaaaattttcgcgggccctcgaagtctcaagcctcttctcatagccacttgcgttggccttccctctggacaaatacttagacattttcttcctcaattcgagtactgtgatgtggtagcgcttgcggcagcaacatggactgcagcattcctctctctatattacgcgggcattagagcaaaaccagttgatacgatggactccgaaggtcgcatttggaataagatatcacaagatagatcattccacgaattcacaagtccgggtcgtgagttattactatctcaagacgagctccgcatgactttcgagaatctggatgcccttaacgatgacgaaaaatatgaagtcgatcctatgacacatcccggtttggaaattaagtcgattctacatcatgctgttggaatatttgaagagatcaaaggcagctcggttgattcaatcccaaattttgctctgagtgcatttccggaagtaaaggcattattggatgagaccatcacagcttttgaaagtggaaagattgtggtcgaatgcgtcgctatgtctatgttctctgatgaattcaaggacctaaaagcaattggctgcgattccagtaatctaatgaggatcatcattggttgcgaaacaatggatgcgatggaccagaattcaagcatcagtcttttctgccaggcgtaagtgacatttctcctattgccgccaccagtgtcagattccttactggagtcattctatagcccgaccatttttagtgctaacctgctacaggactgccgaaatactgcttcacattgcagccgaaacttttcagggtgtttcgcacgaagacgctatactcctggaatcattgctctcttccgtttcaccgtcaggcctattggagcaaacccttgtacctcagggactacgaaacttcttgaatttctcaaacccctcaaaagccgatgcagaaaatgttgcgacctgttttgatgacgaaatccttagacatacagctatcggatgcaacccaaacattgattgggaaggacttcctacagagattcgagagctcattctcgacagatgcacgggacaagttgatgcattgacaactgaccagcatagttgggtacgagcgaacaagctcaaaggcctacccatcgccactttcttagctcgccgcaattttggtgccttcgttgccactgaaaagaaacggtacacattggaatttgcgaagactgctccggtagagagttccgataagcatgaaaagtctaacataatgaacttatttggaaagacacaaacacggagattgacagcagatttaatcacaaaacagctgaaatggccattcagtaaggtttatcatacgattgggcattgcctgaagttattcgcgatagcatttgtggcagagccagagttgcaaagagagctcaattataccatgaagtcaactccaaagtacatgcgatcgattgtcatgttcttgataactggaatatggtcatacgcgaattttttgcagggtattttgatgcccattttcttgctccatggtagaaagaatgtagaaactctctggaaacaaatacgtggtacgacagtgtcattaaagcgtcaaaggataatgatagacagcactggagggtcttcgacagcatttgttcgagtcccggatacagccagcattactggtagccatatcattaacaatggtagggaaggtgctgaagccatacaagagtcgttactcagcaatggcatctgcgagctccgacaatatggtggtgtcctcaagcaagagccagccgattcagccaagcttgagcgcattagcatttacagcaaggatcttcttcttttacgcagagaagactatgtcaaaggcgtgaaagcaaacgtttatgaatatgaatacgacttggaaaagatttcaaaacagaatgtcatgacaacacgtcggcgctatccgatttcgcgacgatgtgtggaagggagtaaccaatttgaacaagtgttgttcaataaacaaggtcttgttcaaagtgggtcctacattctcgatggaaatctcgtgcgcttcaattgccattatagacaaaacagcaattttgaagatgagttgttgagagcagagtttgtattgccgcatatgttttgcatggtttcatgggccgctcctcctgctaaacgtcaagacaagctggacacatggataccccattcacaagttatcgaggccacctttgtcatcggccccgatgtatatgagtcacagtggtcatatgatcataaatatcatccaaccatatacacaacattgaatggcgagcctgtcgacacacctgcgctgatagaatgggatcatctcggagtcctcaaaaagcccaccaactttgcatttcgccatgatgatcacatgattggctttaaatcattacgctcacatgctttgcccagatggctaggcatgaatacccatcaaaatccagtctccacttcgaaagctaggtcgaggctatggcaagcatggaaaaacaattcggcgtatgatggtgtaatcatgagatggcttgacgaaagacttcttcgacgggaaccaatgttgcgcccatattatcgaagacgtgatcacggcaacctcaggctggctgaagaatatttgcatgagaatgcagacgcaattatggccgttatcgatcttgataaatcaatttcgggatgggcaccactcgcatttcagattgcagatttgtacgcatttggacaggggggttctgccaatgctcgcacgaggtctgccccagatttcaaaagcgacgagcttcatgttcttgccacagactccggaacttggcccaatgaaggaggtggggtgtctgcatgtcgaagagacatggtaaacaatcttaaggcagcgaaatggtacatgatttcagaatcagcgaatgactttggagtgcctaaacatcaaacacaagagaacgtccaaacactgaaagtcattccaatttggggactcgatttcatgacaccgacccatggaattttcagagatcgattagattcagaggtcattcatgctgtcagagatgcgacaaaattagacattcagaagaattttgttccaattctcaaagctctggtgaaaggggctagaacgagtcaatattcgaacagtgacattctccaatcaacccgagctttggtcaacctaaacgcgtatttctcccaaggaaaacattggacgggtgtctggaacagtagaatcgttaagaatgcctggcggaacctatggatctcacaagaccttgtgagcccaactccctcagagggttggtttcagactgagatacctacaatagctcaactcgacgccgcactcgatctctggtttcgctacttgtttatattctctcttcccatgcctgagaggattccggcgattttccaagcgtcacatcattccgtcagtgcttcgtatggaattgtgtgcaagattactaggggcagcacattgcaaatctgggatcacgctattagttggcgcgaaacaaatctctacctgtcttcagatctttgctctctaccaccatttgtcagaaactcgttacttggtctcatgaagctcaccagtcaactgacacttcaccacgccgatatcattctaccttgcgccgacttcttcaatcctggatgggaaatcgaaattggatcacaccaaggcaaactcgagcaccgaaacattttcaagcgcaagattgatcctgtcgttaatggtatcccacctgcagatatctctaaattcagtccaatcaaggagacaacttcacctttgccaacagtcaccatgctttctcatgtttggtatgcgaaggatatcaagactgccattttagctgctgatatcattgtaaatgtatggggatttaaagactatcgcctcgatatctacggtgcaattgacaaagcaccacaatactcaacagactgtttcgaaatattagcctccaaatccttaccaggctatgtcaacttgtgcggaactgcaagcccaactgatgtgctcaagaaaacttgggtcttccttaattcttctatctccgaggggcttcccttagcattgggcgaagcagctttgactggcgcgcctgttgtatgtacagatgttggggcttcccttcgggttcttacagatttcaacaccggcgactgcttcagtgctgtggttgcccccaatgatgcacaaagtcttgcaagagcgcagatcaatatgcttggtcttttggacgaatgggctccttatgcgaatgaccctcaaggttacaagcctccttctatcatcgataagccttctgcagaagaagttgcgattattaccaagagaatgtatgagaagaaaggcgaacttcgagcccttggaatgcgaagtcgagaaattgttcaaaaatctttcggaggcaacaggtatctcagagagcatgagcagatgctctggattggaaagtctcgctacgacataaaattcccttcaaaacaaccaagacccacattaagacctgcactaccatcactcgcagtagcaagtaacatgtggggacaagcatctataccctctgctatccagactcgacctatgcgaccatccatcttccggggatccagtcctagcataatggcacgatccatgcaagcagcttcaaccgttgttccatcccccactctcgaaagacctacttccatcatgggttacggcagtggtgtcaagggttatcaaaatatcaacgattacttcgccggctaccgacctggcgatagtaacgcctctactcccgatctccaattcctcacgcctcctggtatccacacgcccggtggtaattctgttagaagccagtcaccgatgaggaaaggggcatctacacgtcttacgatgctctctagaggcagcactagttacgatactagatctgagagttcctcattaatcgtaccctctaaacgattacctggagaggattcattccttcgtgatctggacaccgctcttggacgcgtgtaa

The invention claimed is:

1. A mutant filamentous fungus, which is deficient in at least part of a GAG biosynthetic cluster, lacks expression of α-1,3-glucan, and
   is more suppressed in aggregation of cells in a medium than
   a filamentous fungus which is not deficient in a GAG biosynthetic cluster and has expression of α-1,3-glucan,
   a filamentous fungus which is deficient in at least part of a GAG biosynthetic cluster and has expression of α-1,3-glucan, and
   a filamentous fungus which is not deficient in a GAG biosynthetic cluster and lacks expression of α-1,3-glucan.

2. The filamentous fungus according to claim 1, wherein the filamentous fungus is deficient in at least one GAG biosynthetic gene selected from the group consisting of uge3, sph3, ega3, agd3, and gtb3.

3. The filamentous fungus according to claim 1, wherein the filamentous fungus belongs to a genus *Aspergillus*, a genus *Botrytis*, or a genus *Cochliobolus*.

4. The filamentous fungus according to claim 3, wherein the filamentous fungus is *Aspergillus oryzae*, *Aspergillus sojae*, *Aspergillus nidulans*, *Aspergillus niger*, *Aspergillus fumigatus*, *Botrytis cinerea*, or *Cochliobolus heterostrophus*.

5. The filamentous fungus according to claim 1, wherein the filamentous fungus is deficient in at least one α-1,3-glucan synthase.

6. A method of producing a substance, comprising the steps of:
   culturing the filamentous fungus of claim 1 to allow the filamentous fungus to produce a substance; and
   collecting the resulting substance.

7. The method according to claim 6, wherein the substance is a substance other than a cell wall constituent component of the filamentous fungus or a hydrolysate thereof.

* * * * *